United States Patent 12,331,293 (BISPECIFIC ANTISENSE OLIGONUCLEOTIDES FOR DYSTROPHIN EXON SKIPPING) - sequence listing, part 2

SEQ ID NO: 12207 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12208 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12209 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12210 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12211 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12212 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12213 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12214 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12215 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12216 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12217 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12218 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12219 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12220 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12221 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12222 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12223 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12224 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12225 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 12226 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12227 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12228 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12229 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12230 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12231 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12232 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12233 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12234 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12235 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12236 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12237 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12238 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12239 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12240 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12241 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12242 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12243 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12244 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12245 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12246 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 12247 - RNA, 18 nt, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
gguaaguucuguccaagc

SEQ ID NO: 12248 - RNA, 18 nt, Artificial Sequence
  Description of Artificial Sequence: Synthetic Antisense oligonucleotide
  misc_feature (9)..(9): bicyclic nucleic acid (BNA)
  misc_feature (18)..(18): bicyclic nucleic acid (BNA)
gguaaguucuguccaagc

SEQ ID NO: 12249 - RNA, 18 nt, Artificial Sequence
  Description of Artificial Sequence: Synthetic Antisense oligonucleotide
  misc_feature (11)..(11): bicyclic nucleic acid (BNA)
  misc_feature (18)..(18): bicyclic nucleic acid (BNA)
gguaaguucuguccaagc

SEQ ID NO: 12250 - RNA, 18 nt, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
gguaaguucuguccaagc

SEQ ID NO: 12251 - RNA, 18 nt, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
gguaaguucuguccaagc

SEQ ID NO: 12252 - RNA, 18 nt, Artificial Sequence
  Description of Artificial Sequence: Synthetic Antisense oligonucleotide
  misc_feature (14)..(14): bicyclic nucleic acid (BNA)
  misc_feature (18)..(18): bicyclic nucleic acid (BNA)
gguaaguucuguccaagc

SEQ ID NO: 12253 - RNA, 18 nt, Artificial Sequence
  Description of Artificial Sequence: Synthetic Antisense oligonucleotide
  misc_feature (16)..(16): bicyclic nucleic acid (BNA)
  misc_feature (18)..(18): bicyclic nucleic acid (BNA)
guaaguucuguccaagcc

SEQ ID NO: 12254 - RNA, 18 nt, Artificial Sequence
  Description of Artificial Sequence: Synthetic Antisense oligonucleotide
  misc_feature (10)..(10): bicyclic nucleic acid (BNA)
  misc_feature (18)..(18): bicyclic nucleic acid (BNA)
guaaguucuguccaagcc

SEQ ID NO: 12255 - RNA, 18 nt, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
guaaguucuguccaagcc

SEQ ID NO: 12256 - RNA, 18 nt, Artificial Sequence
  Description of Artificial Sequence: Synthetic Antisense oligonucleotide
  misc_feature (12)..(12): bicyclic nucleic acid (BNA)
  misc_feature (18)..(18): bicyclic nucleic acid (BNA)
guaaguucuguccaagcc

SEQ ID NO: 12257 - RNA, 18 nt, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
guaaguucuguccaagcc

SEQ ID NO: 12258 - RNA, 18 nt, Artificial Sequence
  Description of Artificial Sequence: Synthetic Antisense oligonucleotide
  misc_feature (8)..(8): bicyclic nucleic acid (BNA)
  misc_feature (18)..(18): bicyclic nucleic acid (BNA)
guaaguucuguccaagcc

SEQ ID NO: 12259 - RNA, 18 nt, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
agucgguaaguucugucc

SEQ ID NO: 12260 - RNA, 18 nt, Artificial Sequence
  Description of Artificial Sequence: Synthetic Antisense oligonucleotide
  misc_feature (4)..(4): bicyclic nucleic acid (BNA)
  misc_feature (18)..(18): bicyclic nucleic acid (BNA)
agucgguaaguucugucc

SEQ ID NO: 12261 - RNA, 18 nt, Artificial Sequence
  Description of Artificial Sequence: Synthetic Antisense oligonucleotide
  misc_feature (10)..(10): bicyclic nucleic acid (BNA)
  misc_feature (18)..(18): bicyclic nucleic acid (BNA)
agucgguaaguucugucc

SEQ ID NO: 12262 - RNA, 18 nt, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
agucgguaaguucugucc

SEQ ID NO: 12263 - RNA, 18 nt, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
agucgguaaguucugucc

SEQ ID NO: 12264 - RNA, 18 nt, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
agucgguaaguucugucc

SEQ ID NO: 12265 - RNA, 18 nt, Artificial Sequence
  Description of Artificial Sequence: Synthetic Antisense oligonucleotide
  misc_feature (15)..(15): bicyclic nucleic acid (BNA)
  misc_feature (18)..(18): bicyclic nucleic acid (BNA)
agucgguaaguucugucc

SEQ ID NO: 12266 - RNA, 18 nt, Artificial Sequence
  Description of Artificial Sequence: Synthetic Antisense oligonucleotide
  misc_feature (3)..(3): bicyclic nucleic acid (BNA)
  misc_feature (18)..(18): bicyclic nucleic acid (BNA)
cuguccaagcccgguuga

SEQ ID NO: 12267 - RNA, 18 nt, Artificial Sequence
  Description of Artificial Sequence: Synthetic Antisense oligonucleotide
  misc_feature (9)..(9): bicyclic nucleic acid (BNA)
  misc_feature (18)..(18): bicyclic nucleic acid (BNA)
cuguccaagcccgguuga

SEQ ID NO: 12268 - RNA, 18 nt, Artificial Sequence
  Description of Artificial Sequence: Synthetic Antisense oligonucleotide
  misc_feature (10)..(10): bicyclic nucleic acid (BNA)
  misc_feature (18)..(18): bicyclic nucleic acid (BNA)
cuguccaagcccgguuga

SEQ ID NO: 12269 - RNA, 18 nt, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
cuguccaagcccgguuga

SEQ ID NO: 12270 - RNA, 18 nt, Artificial Sequence
  Description of Artificial Sequence: Synthetic Antisense oligonucleotide
  misc_feature (11)..(11): bicyclic nucleic acid (BNA)
  misc_feature (18)..(18): bicyclic nucleic acid (BNA)
cuguccaagcccgguuga

SEQ ID NO: 12271 - RNA, 18 nt, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
cuguccaagcccgguuga

SEQ ID NO: 12272 - RNA, 18 nt, Artificial Sequence
  Description of Artificial Sequence: Synthetic Antisense oligonucleotide
  misc_feature (12)..(12): bicyclic nucleic acid (BNA)
  misc_feature (18)..(18): bicyclic nucleic acid (BNA)
cuguccaagcccgguuga

SEQ ID NO: 12273 - RNA, 18 nt, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
cuguccaagcccgguuga

SEQ ID NO: 12274 - RNA, 18 nt, Artificial Sequence
  Description of Artificial Sequence: Synthetic Antisense oligonucleotide
  misc_feature (14)..(14): bicyclic nucleic acid (BNA)
  misc_feature (18)..(18): bicyclic nucleic acid (BNA)
cuguccaagcccgguuga

SEQ ID NO: 12275 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 12276 - RNA, 18 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12277 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12278 - RNA, 18 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12279 - RNA, 18 nt, Artificial Sequence
  Description of Artificial Sequence: Synthetic Antisense oligonucleotide
  misc_feature (13)..(14): bicyclic nucleic acid (BNA)
  misc_feature (18)..(18): bicyclic nucleic acid (BNA)
gguaaguucuguccaagc

SEQ ID NO: 12280 - RNA, 18 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12281 - RNA, 18 nt, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12282 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12283 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12284 - RNA, 18 nt, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 12285 - RNA, 18 nt, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12286 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
gguaaguucuguccaagc

SEQ ID NO: 12287 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (18)..(18): bicyclic nucleic acid (BNA)
gguaaguucuguccaagc

SEQ ID NO: 12288 - RNA, 18 nt, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 12289 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
gguaaguucuguccaagc

SEQ ID NO: 12290 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
guaaguucuguccaagcc

SEQ ID NO: 12291 - RNA, 18 nt, Artificial Sequence
  Description of Artificial Sequence: Synthetic Antisense oligonucleotide
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12292 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
guaaguucuguccaagcc

SEQ ID NO: 12293 - RNA, 18 nt, Artificial Sequence
  Description of Artificial Sequence: Synthetic Antisense oligonucleotide
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12294 - RNA, 18 nt, Artificial Sequence
  Description of Artificial Sequence: Synthetic Antisense oligonucleotide
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12295 - RNA, 18 nt, Artificial Sequence
  Description of Artificial Sequence: Synthetic Antisense oligonucleotide
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 12296 - RNA, 18 nt, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12297 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 12298 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 12299 - RNA, 18 nt, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 12300 - RNA, 18 nt, Artificial Sequence
  Description of Artificial Sequence: Synthetic Antisense oligonucleotide
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 12301 - RNA, 18 nt, Artificial Sequence
  Description of Artificial Sequence: Synthetic Antisense oligonucleotide
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12302 - RNA, 18 nt, Artificial Sequence
  Description of Artificial Sequence: Synthetic Antisense oligonucleotide
  misc_feature (12)..(13): bicyclic nucleic acid (BNA)
  misc_feature (18)..(18): bicyclic nucleic acid (BNA)
guaaguucuguccaagcc

SEQ ID NO: 12303 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 12304 - RNA, 18 nt, Artificial Sequence
  Description of Artificial Sequence: Synthetic Antisense oligonucleotide
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
guaaguucuguccaagcc

SEQ ID NO: 12305 - RNA, 18 nt, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12306 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (18)..(18): bicyclic nucleic acid (BNA)
agucgguaaguucugucc

SEQ ID NO: 12307 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12308 - RNA, 18 nt, Artificial Sequence
  Description of Artificial Sequence: Synthetic Antisense oligonucleotide
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12309 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12310 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12311 - RNA, 18 nt, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12312 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
agucgguaaguucugucc

SEQ ID NO: 12313 - RNA, 18 nt, Artificial Sequence
  Description of Artificial Sequence: Synthetic Antisense oligonucleotide
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12314 - RNA, 18 nt, Artificial Sequence
  Description of Artificial Sequence: Synthetic Antisense oligonucleotide
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12315 - RNA, 18 nt, Artificial Sequence
  Description of Artificial Sequence: Synthetic Antisense oligonucleotide
  misc_feature (5)..(6): bicyclic nucleic acid (BNA)
  misc_feature (18)..(18): bicyclic nucleic acid (BNA)
agucgguaaguucugucc

SEQ ID NO: 12316 - RNA, 18 nt, Artificial Sequence
  Description of Artificial Sequence: Synthetic Antisense oligonucleotide
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12317 - RNA, 18 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (18)..(18): bicyclic nucleic acid (BNA)
agucgguaaguucugucc

SEQ ID NO: 12318 - RNA, 18 nt, Artificial Sequence
  Description of Artificial Sequence: Synthetic Antisense oligonucleotide
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12319 - RNA, 18 nt, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12320 - RNA, 18 nt, Artificial Sequence
  Description of Artificial Sequence: Synthetic Antisense oligonucleotide
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
agucgguaaguucugucc

SEQ ID NO: 12321 - RNA, 18 nt, Artificial Sequence
  Description of Artificial Sequence: Synthetic Antisense oligonucleotide
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12322 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12323 - RNA, 18 nt, Artificial Sequence
  Description of Artificial Sequence: Synthetic Antisense oligonucleotide
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12324 - RNA, 18 nt, Artificial Sequence
  Description of Artificial Sequence: Synthetic Antisense oligonucleotide
  misc_feature (4)..(5): bicyclic nucleic acid (BNA)
  misc_feature (18)..(18): bicyclic nucleic acid (BNA)
agucgguaaguucugucc

SEQ ID NO: 12325 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12326 - RNA, 18 nt, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12327 - RNA, 18 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12328 - RNA, 18 nt, Artificial Sequence
  Description of Artificial Sequence: Synthetic Antisense oligonucleotide
  misc_feature (11)..(12): bicyclic nucleic acid (BNA)
  misc_feature (18)..(18): bicyclic nucleic acid (BNA)
cuguccaagcccgguuga

SEQ ID NO: 12329 - RNA, 18 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12330 - RNA, 18 nt, Artificial Sequence
  Description of Artificial Sequence: Synthetic Antisense oligonucleotide
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12331 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12332 - RNA, 18 nt, Artificial Sequence
  Description of Artificial Sequence: Synthetic Antisense oligonucleotide
  misc_feature (9)..(10): bicyclic nucleic acid (BNA)
  misc_feature (18)..(18): bicyclic nucleic acid (BNA)
cuguccaagcccgguuga

SEQ ID NO: 12333 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12334 - RNA, 18 nt, Artificial Sequence
  Description of Artificial Sequence: Synthetic Antisense oligonucleotide
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12335 - RNA, 18 nt, Artificial Sequence
  Description of Artificial Sequence: Synthetic Antisense oligonucleotide
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
cuguccaagcccgguuga

SEQ ID NO: 12336 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12337 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12338 - RNA, 18 nt, Artificial Sequence
  Description of Artificial Sequence: Synthetic Antisense oligonucleotide
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12339 - RNA, 18 nt, Artificial Sequence
  Description of Artificial Sequence: Synthetic Antisense oligonucleotide
  misc_feature (13)..(14): bicyclic nucleic acid (BNA)
  misc_feature (18)..(18): bicyclic nucleic acid (BNA)
cuguccaagcccgguuga

SEQ ID NO: 12340 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12341 - RNA, 18 nt, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12342 - RNA, 18 nt, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12343 - RNA, 18 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12344 - RNA, 18 nt, Artificial Sequence
  Description of Artificial Sequence: Synthetic Antisense oligonucleotide
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12345 - RNA, 18 nt, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12346 - RNA, 18 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12347 - RNA, 18 nt, Artificial Sequence
  Description of Artificial Sequence: Synthetic Antisense oligonucleotide
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12348 - RNA, 18 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12349 - RNA, 18 nt, Artificial Sequence
  Description of Artificial Sequence: Synthetic Antisense oligonucleotide
  misc_feature (5)..(6): bicyclic nucleic acid (BNA)
  misc_feature (18)..(18): bicyclic nucleic acid (BNA)
cuguccaagcccgguuga

SEQ ID NO: 12350 - RNA, 18 nt, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12351 - RNA, 18 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12352 - RNA, 18 nt, Artificial Sequence
  Description of Artificial Sequence: Synthetic Antisense oligonucleotide
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12353 - RNA, 18 nt, Artificial Sequence
  Description of Artificial Sequence: Synthetic Antisense oligonucleotide
  misc_feature (10)..(11): bicyclic nucleic acid (BNA)
  misc_feature (18)..(18): bicyclic nucleic acid (BNA)
cuguccaagcccgguuga

SEQ ID NO: 12354 - RNA, 18 nt, Artificial Sequence
  Description of Artificial Sequence: Synthetic Antisense oligonucleotide
  misc_feature (12)..(13): bicyclic nucleic acid (BNA)
  misc_feature (18)..(18): bicyclic nucleic acid (BNA)
cuguccaagcccgguuga

SEQ ID NO: 12355 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12356 - RNA, 18 nt, Artificial Sequence
  Description of Artificial Sequence: Synthetic Antisense oligonucleotide
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12357 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12358 - RNA, 18 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12359 - RNA, 18 nt, Artificial Sequence
  Description of Artificial Sequence: Synthetic Antisense oligonucleotide
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12360 - RNA, 18 nt, Artificial Sequence
  Description of Artificial Sequence: Synthetic Antisense oligonucleotide
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
cuguccaagcccgguuga

SEQ ID NO: 12361 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12362 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (20)..(20): bicyclic nucleic acid (BNA)
ucaaggaagauggcauuuct

SEQ ID NO: 12363 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (20)..(20): bicyclic nucleic acid (BNA)
ucaaggaagauggcauuuct

SEQ ID NO: 12364 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (20)..(20): bicyclic nucleic acid (BNA)
ucaaggaagauggcauuuct

SEQ ID NO: 12365 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (20)..(20): bicyclic nucleic acid (BNA)
ucaaggaagauggcauuuct

SEQ ID NO: 12366 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
  misc_feature (20)..(20): bicyclic nucleic acid (BNA)
ucaaggaagauggcauuuct

SEQ ID NO: 12367 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
  misc_feature (20)..(20): bicyclic nucleic acid (BNA)
ucaaggaagauggcauuuct

SEQ ID NO: 12368 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
  misc_feature (20)..(20): bicyclic nucleic acid (BNA)
ucaaggaagauggcauuuct

SEQ ID NO: 12369 - RNA, 22 nt, Artificial Sequence
  Description of Artificial Sequence: Synthetic Antisense oligonucleotide
  misc_feature (2)..(2): bicyclic nucleic acid (BNA)
  misc_feature (22)..(22): bicyclic nucleic acid (BNA)
ucaaggaagauggcauuucuag

SEQ ID NO: 12370 - RNA, 22 nt, Artificial Sequence
  Description of Artificial Sequence: Synthetic Antisense oligonucleotide
  misc_feature (9)..(9): bicyclic nucleic acid (BNA)
  misc_feature (22)..(22): bicyclic nucleic acid (BNA)
ucaaggaagauggcauuucuag

SEQ ID NO: 12371 - RNA, 22 nt, Artificial Sequence
  Description of Artificial Sequence: Synthetic Antisense oligonucleotide
  misc_feature (5)..(5): bicyclic nucleic acid (BNA)
  misc_feature (22)..(22): bicyclic nucleic acid (BNA)
ucaaggaagauggcauuucuag

SEQ ID NO: 12372 - RNA, 22 nt, Artificial Sequence
  Description of Artificial Sequence: Synthetic Antisense oligonucleotide
  misc_feature (6)..(6): bicyclic nucleic acid (BNA)
  misc_feature (22)..(22): bicyclic nucleic acid (BNA)
ucaaggaagauggcauuucuag

SEQ ID NO: 12373 - RNA, 22 nt, Artificial Sequence
  Description of Artificial Sequence: Synthetic Antisense oligonucleotide
  misc_feature (12)..(12): bicyclic nucleic acid (BNA)
  misc_feature (22)..(22): bicyclic nucleic acid (BNA)
ucaaggaagauggcauuucuag

SEQ ID NO: 12374 - RNA, 22 nt, Artificial Sequence
  Description of Artificial Sequence: Synthetic Antisense oligonucleotide
  misc_feature (13)..(13): bicyclic nucleic acid (BNA)
  misc_feature (22)..(22): bicyclic nucleic acid (BNA)
ucaaggaagauggcauuucuag

SEQ ID NO: 12375 - RNA, 22 nt, Artificial Sequence
  Description of Artificial Sequence: Synthetic Antisense oligonucleotide
  misc_feature (19)..(19): bicyclic nucleic acid (BNA)
  misc_feature (22)..(22): bicyclic nucleic acid (BNA)
ucaaggaagauggcauuucuag

SEQ ID NO: 12376 - RNA, 22 nt, Artificial Sequence
  Description of Artificial Sequence: Synthetic Antisense oligonucleotide
  misc_feature (14)..(14): bicyclic nucleic acid (BNA)
  misc_feature (22)..(22): bicyclic nucleic acid (BNA)
ucaaggaagauggcauuucuag

SEQ ID NO: 12377 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12378 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
ucaaggaagauggcauuuct

SEQ ID NO: 12379 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12380 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12381 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12382 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
ucaaggaagauggcauuuct

SEQ ID NO: 12383 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
  misc_feature (20)..(20): bicyclic nucleic acid (BNA)
ucaaggaagauggcauuuct

SEQ ID NO: 12384 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12385 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12386 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (6)..(6): bicyclic nucleic acid (BNA)
  misc_feature (20)..(20): bicyclic nucleic acid (BNA)
ucaaggaagauggcauuuct

SEQ ID NO: 12387 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12388 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12389 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(6): bicyclic nucleic acid (BNA)
  misc_feature (20)..(20): bicyclic nucleic acid (BNA)
ucaaggaagauggcauuuct

SEQ ID NO: 12390 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12391 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12392 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (5)..(5): bicyclic nucleic acid (BNA)
  misc_feature (20)..(20): bicyclic nucleic acid (BNA)
ucaaggaagauggcauuuct

SEQ ID NO: 12393 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
  misc_feature (20)..(20): bicyclic nucleic acid (BNA)
ucaaggaagauggcauuuct

SEQ ID NO: 12394 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12395 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12396 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12397 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (9)..(9): bicyclic nucleic acid (BNA)
  misc_feature (20)..(20): bicyclic nucleic acid (BNA)
ucaaggaagauggcauuuct

SEQ ID NO: 12398 - RNA, 22 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12399 - RNA, 22 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
ucaaggaagauggcauuucuag

SEQ ID NO: 12400 - RNA, 22 nt, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12401 - RNA, 22 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12402 - RNA, 22 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12403 - RNA, 22 nt, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12404 - RNA, 22 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
ucaaggaagauggcauuucuag

SEQ ID NO: 12405 - RNA, 22 nt, Artificial Sequence
  Description of Artificial Sequence: Synthetic Antisense oligonucleotide
  misc_feature (13)..(14): bicyclic nucleic acid (BNA)
  misc_feature (22)..(22): bicyclic nucleic acid (BNA)
ucaaggaagauggcauuucuag

SEQ ID NO: 12406 - RNA, 22 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12407 - RNA, 22 nt, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12408 - RNA, 22 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12409 - RNA, 22 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (22)..(22): bicyclic nucleic acid (BNA)
ucaaggaagauggcauuucuag

SEQ ID NO: 12410 - RNA, 22 nt, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12411 - RNA, 22 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12412 - RNA, 22 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12413 - RNA, 22 nt, Artificial Sequence
  Description of Artificial Sequence: Synthetic Antisense oligonucleotide
  misc_feature (5)..(6): bicyclic nucleic acid (BNA)
  misc_feature (22)..(22): bicyclic nucleic acid (BNA)
ucaaggaagauggcauuucuag

SEQ ID NO: 12414 - RNA, 22 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12415 - RNA, 22 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12416 - RNA, 22 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (22)..(22): bicyclic nucleic acid (BNA)
ucaaggaagauggcauuucuag

SEQ ID NO: 12417 - RNA, 22 nt, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12418 - RNA, 22 nt, Artificial Sequence
  Description of Artificial Sequence: Synthetic Antisense oligonucleotide
  misc_feature (12)..(13): bicyclic nucleic acid (BNA)
  misc_feature (22)..(22): bicyclic nucleic acid (BNA)
ucaaggaagauggcauuucuag

SEQ ID NO: 12419 - RNA, 22 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12420 - RNA, 22 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12421 - RNA, 22 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12422 - RNA, 22 nt, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12423 - RNA, 22 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (22)..(22): bicyclic nucleic acid (BNA)
ucaaggaagauggcauuucuag

SEQ ID NO: 12424 - RNA, 22 nt, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12425 - RNA, 22 nt, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12426 - RNA, 18 nt, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12427 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (18)..(18): bicyclic nucleic acid (BNA)
gguaaguucuguccaagc

SEQ ID NO: 12428 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (18)..(18): bicyclic nucleic acid (BNA)
gguaaguucuguccaagc

SEQ ID NO: 12429 - RNA, 18 nt, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12430 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
  misc_feature (18)..(18): bicyclic nucleic acid (BNA)
gguaaguucuguccaagc

SEQ ID NO: 12431 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
  misc_feature (18)..(18): bicyclic nucleic acid (BNA)
gguaaguucuguccaagc

SEQ ID NO: 12432 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(16): bicyclic nucleic acid (BNA)
  misc_feature (18)..(18): bicyclic nucleic acid (BNA)
guaaguucuguccaagcc

SEQ ID NO: 12433 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (18)..(18): bicyclic nucleic acid (BNA)
guaaguucuguccaagcc

SEQ ID NO: 12434 - RNA, 18 nt, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 12435 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (18)..(18): bicyclic nucleic acid (BNA)
guaaguucuguccaagcc

SEQ ID NO: 12436 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (18)..(18): bicyclic nucleic acid (BNA)
guaaguucuguccaagcc

SEQ ID NO: 12437 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (18)..(18): bicyclic nucleic acid (BNA)
guaaguucuguccaagcc

SEQ ID NO: 12438 - RNA, 18 nt, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12439 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (18)..(18): bicyclic nucleic acid (BNA)
agucgguaaguucugucc

SEQ ID NO: 12440 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (18)..(18): bicyclic nucleic acid (BNA)
agucgguaaguucugucc

SEQ ID NO: 12441 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (18)..(18): bicyclic nucleic acid (BNA)
agucgguaaguucugucc

SEQ ID NO: 12442 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (18)..(18): bicyclic nucleic acid (BNA)
agucgguaaguucugucc

SEQ ID NO: 12443 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (18)..(18): bicyclic nucleic acid (BNA)
agucgguaaguucugucc

SEQ ID NO: 12444 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
  misc_feature (18)..(18): bicyclic nucleic acid (BNA)
agucgguaaguucugucc

SEQ ID NO: 12445 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (18)..(18): bicyclic nucleic acid (BNA)
cuguccaagcccgguuga

SEQ ID NO: 12446 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (18)..(18): bicyclic nucleic acid (BNA)
cuguccaagcccgguuga

SEQ ID NO: 12447 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (18)..(18): bicyclic nucleic acid (BNA)
cuguccaagcccgguuga

SEQ ID NO: 12448 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (18)..(18): bicyclic nucleic acid (BNA)
cuguccaagcccgguuga

SEQ ID NO: 12449 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (18)..(18): bicyclic nucleic acid (BNA)
cuguccaagcccgguuga

SEQ ID NO: 12450 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (18)..(18): bicyclic nucleic acid (BNA)
cuguccaagcccgguuga

SEQ ID NO: 12451 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (18)..(18): bicyclic nucleic acid (BNA)
cuguccaagcccgguuga

SEQ ID NO: 12452 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
  misc_feature (18)..(18): bicyclic nucleic acid (BNA)
cuguccaagcccgguuga

SEQ ID NO: 12453 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
  misc_feature (18)..(18): bicyclic nucleic acid (BNA)
cuguccaagcccgguuga

SEQ ID NO: 12454 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12455 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12456 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12457 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12458 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(14): bicyclic nucleic acid (BNA)
  misc_feature (18)..(18): bicyclic nucleic acid (BNA)
gguaaguucuguccaagc

SEQ ID NO: 12459 - RNA, 18 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12460 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12461 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12462 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12463 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 12464 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12465 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12466 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12467 - RNA, 18 nt, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12468 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 12469 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 12470 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12471 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 12472 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12473 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12474 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 12475 - RNA, 18 nt, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 12476 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 12477 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 12478 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 12479 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 12480 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12481 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(13): bicyclic nucleic acid (BNA)
  misc_feature (18)..(18): bicyclic nucleic acid (BNA)
guaaguucuguccaagcc

SEQ ID NO: 12482 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 12483 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
guaaguucuguccaagcc

SEQ ID NO: 12484 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12485 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12486 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12487 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12488 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12489 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12490 - RNA, 18 nt, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12491 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12492 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12493 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12494 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(6): bicyclic nucleic acid (BNA)
  misc_feature (18)..(18): bicyclic nucleic acid (BNA)
agucgguaaguucugucc

SEQ ID NO: 12495 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12496 - RNA, 18 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12497 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12498 - RNA, 18 nt, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12499 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
agucgguaaguucugucc

SEQ ID NO: 12500 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12501 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 12502 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12503 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(5): bicyclic nucleic acid (BNA)
  misc_feature (18)..(18): bicyclic nucleic acid (BNA)
agucgguaaguucugucc

SEQ ID NO: 12504 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12505 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12506 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12507 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
  misc_feature (18)..(18): bicyclic nucleic acid (BNA)
cuguccaagcccgguuga

SEQ ID NO: 12508 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12509 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12510 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12511 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(10): bicyclic nucleic acid (BNA)
  misc_feature (18)..(18): bicyclic nucleic acid (BNA)
cuguccaagcccgguuga

SEQ ID NO: 12512 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12513 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12514 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
cuguccaagcccgguuga

SEQ ID NO: 12515 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12516 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12517 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12518 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
  misc_feature (18)..(18): bicyclic nucleic acid (BNA)
cuguccaagcccgguuga

SEQ ID NO: 12519 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12520 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12521 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12522 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12523 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12524 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12525 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12526 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12527 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12528 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(6): bicyclic nucleic acid (BNA)
  misc_feature (18)..(18): bicyclic nucleic acid (BNA)
cuguccaagcccgguuga

SEQ ID NO: 12529 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12530 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12531 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12532 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(11): bicyclic nucleic acid (BNA)
  misc_feature (18)..(18): bicyclic nucleic acid (BNA)
cuguccaagcccgguuga

SEQ ID NO: 12533 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
  misc_feature (18)..(18): bicyclic nucleic acid (BNA)
cuguccaagcccgguuga

SEQ ID NO: 12534 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12535 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12536 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12537 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12538 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12539 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
cuguccaagcccgguuga

SEQ ID NO: 12540 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12541 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (20)..(20): bicyclic nucleic acid (BNA)
ucaaggaagauggcauuuct

SEQ ID NO: 12542 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (20)..(20): bicyclic nucleic acid (BNA)
ucaaggaagauggcauuuct

SEQ ID NO: 12543 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (20)..(20): bicyclic nucleic acid (BNA)
ucaaggaagauggcauuuct

SEQ ID NO: 12544 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (20)..(20): bicyclic nucleic acid (BNA)
ucaaggaagauggcauuuct

SEQ ID NO: 12545 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (20)..(20): bicyclic nucleic acid (BNA)
ucaaggaagauggcauuuct

SEQ ID NO: 12546 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (20)..(20): bicyclic nucleic acid (BNA)
ucaaggaagauggcauuuct

SEQ ID NO: 12547 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (20)..(20): bicyclic nucleic acid (BNA)
ucaaggaagauggcauuuct

SEQ ID NO: 12548 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (22)..(22): bicyclic nucleic acid (BNA)
ucaaggaagauggcauuucuag

SEQ ID NO: 12549 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (22)..(22): bicyclic nucleic acid (BNA)
ucaaggaagauggcauuucuag

SEQ ID NO: 12550 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (22)..(22): bicyclic nucleic acid (BNA)
ucaaggaagauggcauuucuag

SEQ ID NO: 12551 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (22)..(22): bicyclic nucleic acid (BNA)
ucaaggaagauggcauuucuag

SEQ ID NO: 12552 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (22)..(22): bicyclic nucleic acid (BNA)
ucaaggaagauggcauuucuag

SEQ ID NO: 12553 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (22)..(22): bicyclic nucleic acid (BNA)
ucaaggaagauggcauuucuag

SEQ ID NO: 12554 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
  misc_feature (22)..(22): bicyclic nucleic acid (BNA)
ucaaggaagauggcauuucuag

SEQ ID NO: 12555 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (22)..(22): bicyclic nucleic acid (BNA)
ucaaggaagauggcauuucuag

SEQ ID NO: 12556 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12557 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
ucaaggaagauggcauuuct

SEQ ID NO: 12558 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12559 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12560 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12561 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
ucaaggaagauggcauuuct

SEQ ID NO: 12562 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (20)..(20): bicyclic nucleic acid (BNA)
ucaaggaagauggcauuuct

SEQ ID NO: 12563 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12564 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12565 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (20)..(20): bicyclic nucleic acid (BNA)
ucaaggaagauggcauuuct

SEQ ID NO: 12566 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12567 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12568 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (20)..(20): bicyclic nucleic acid (BNA)
ucaaggaagauggcauuuct

SEQ ID NO: 12569 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (20)..(20): bicyclic nucleic acid (BNA)
ucaaggaagauggcauuuct

SEQ ID NO: 12570 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12571 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (20)..(20): bicyclic nucleic acid (BNA)
ucaaggaagauggcauuuct

SEQ ID NO: 12572 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (20)..(20): bicyclic nucleic acid (BNA)
ucaaggaagauggcauuuct

SEQ ID NO: 12573 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
ucaaggaagauggcauuuct

SEQ ID NO: 12574 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12575 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
ucaaggaagauggcauuuct

SEQ ID NO: 12576 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (20)..(20): bicyclic nucleic acid (BNA)
ucaaggaagauggcauuuct

SEQ ID NO: 12577 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12578 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
ucaaggaagauggcauuucuag

SEQ ID NO: 12579 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12580 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12581 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12582 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12583 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
ucaaggaagauggcauuucuag

SEQ ID NO: 12584 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (22)..(22): bicyclic nucleic acid (BNA)
ucaaggaagauggcauuucuag

SEQ ID NO: 12585 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12586 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12587 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12588 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (22)..(22): bicyclic nucleic acid (BNA)
ucaaggaagauggcauuucuag

SEQ ID NO: 12589 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12590 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12591 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12592 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (22)..(22): bicyclic nucleic acid (BNA)
ucaaggaagauggcauuucuag

SEQ ID NO: 12593 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (22)..(22): bicyclic nucleic acid (BNA)
ucaaggaagauggcauuucuag

SEQ ID NO: 12594 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12595 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (22)..(22): bicyclic nucleic acid (BNA)
ucaaggaagauggcauuucuag

SEQ ID NO: 12596 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12597 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (22)..(22): bicyclic nucleic acid (BNA)
ucaaggaagauggcauuucuag

SEQ ID NO: 12598 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
ucaaggaagauggcauuucuag

SEQ ID NO: 12599 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12600 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
ucaaggaagauggcauuucuag

SEQ ID NO: 12601 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12602 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (22)..(22): bicyclic nucleic acid (BNA)
ucaaggaagauggcauuucuag

SEQ ID NO: 12603 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12604 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
ucaaggaagauggcauuucuag

SEQ ID NO: 12605 - DNA, 18 bp, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
ggtaagttctgtccaagc

SEQ ID NO: 12606 - DNA, 18 bp, Artificial Sequence
  Description of Artificial Sequence: Synthetic Antisense oligonucleotide
  misc_feature (9)..(9): bicyclic nucleic acid (BNA)
  misc_feature (18)..(18): bicyclic nucleic acid (BNA)
ggtaagttctgtccaagc

SEQ ID NO: 12607 - DNA, 18 bp, Artificial Sequence
  Description of Artificial Sequence: Synthetic Antisense oligonucleotide
  misc_feature (11)..(11): bicyclic nucleic acid (BNA)
  misc_feature (18)..(18): bicyclic nucleic acid (BNA)
ggtaagttctgtccaagc

SEQ ID NO: 12608 - DNA, 18 bp, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
ggtaagttctgtccaagc

SEQ ID NO: 12609 - DNA, 18 bp, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
ggtaagttctgtccaagc

SEQ ID NO: 12610 - DNA, 18 bp, Artificial Sequence
  Description of Artificial Sequence: Synthetic Antisense oligonucleotide
  misc_feature (14)..(14): bicyclic nucleic acid (BNA)
  misc_feature (18)..(18): bicyclic nucleic acid (BNA)
ggtaagttctgtccaagc

SEQ ID NO: 12611 - DNA, 18 bp, Artificial Sequence
  Description of Artificial Sequence: Synthetic Antisense oligonucleotide
  misc_feature (16)..(16): bicyclic nucleic acid (BNA)
  misc_feature (18)..(18): bicyclic nucleic acid (BNA)
gtaagttctgtccaagcc

SEQ ID NO: 12612 - DNA, 18 bp, Artificial Sequence
  Description of Artificial Sequence: Synthetic Antisense oligonucleotide
  misc_feature (10)..(10): bicyclic nucleic acid (BNA)
  misc_feature (18)..(18): bicyclic nucleic acid (BNA)
gtaagttctgtccaagcc

SEQ ID NO: 12613 - DNA, 18 bp, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
gtaagttctgtccaagcc

SEQ ID NO: 12614 - DNA, 18 bp, Artificial Sequence
  Description of Artificial Sequence: Synthetic Antisense oligonucleotide
  misc_feature (12)..(12): bicyclic nucleic acid (BNA)
  misc_feature (18)..(18): bicyclic nucleic acid (BNA)
gtaagttctgtccaagcc

SEQ ID NO: 12615 - DNA, 18 bp, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
gtaagttctgtccaagcc

SEQ ID NO: 12616 - DNA, 18 bp, Artificial Sequence
  Description of Artificial Sequence: Synthetic Antisense oligonucleotide
  misc_feature (8)..(8): bicyclic nucleic acid (BNA)
  misc_feature (18)..(18): bicyclic nucleic acid (BNA)
gtaagttctgtccaagcc

SEQ ID NO: 12617 - DNA, 18 bp, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
agtcggtaagttctgtcc

SEQ ID NO: 12618 - DNA, 18 bp, Artificial Sequence
  Description of Artificial Sequence: Synthetic Antisense oligonucleotide
  misc_feature (4)..(4): bicyclic nucleic acid (BNA)
  misc_feature (18)..(18): bicyclic nucleic acid (BNA)
agtcggtaagttctgtcc

SEQ ID NO: 12619 - DNA, 18 bp, Artificial Sequence
  Description of Artificial Sequence: Synthetic Antisense oligonucleotide
  misc_feature (10)..(10): bicyclic nucleic acid (BNA)
  misc_feature (18)..(18): bicyclic nucleic acid (BNA)
agtcggtaagttctgtcc

SEQ ID NO: 12620 - DNA, 18 bp, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
agtcggtaagttctgtcc

SEQ ID NO: 12621 - DNA, 18 bp, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
agtcggtaagttctgtcc

SEQ ID NO: 12622 - DNA, 18 bp, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
agtcggtaagttctgtcc

SEQ ID NO: 12623 - DNA, 18 bp, Artificial Sequence
  Description of Artificial Sequence: Synthetic Antisense oligonucleotide
  misc_feature (15)..(15): bicyclic nucleic acid (BNA)
  misc_feature (18)..(18): bicyclic nucleic acid (BNA)
agtcggtaagttctgtcc

SEQ ID NO: 12624 - DNA, 18 bp, Artificial Sequence
  Description of Artificial Sequence: Synthetic Antisense oligonucleotide
  misc_feature (3)..(3): bicyclic nucleic acid (BNA)
  misc_feature (18)..(18): bicyclic nucleic acid (BNA)
ctgtccaagcccggttga

SEQ ID NO: 12625 - DNA, 18 bp, Artificial Sequence
  Description of Artificial Sequence: Synthetic Antisense oligonucleotide
  misc_feature (9)..(9): bicyclic nucleic acid (BNA)
  misc_feature (18)..(18): bicyclic nucleic acid (BNA)
ctgtccaagcccggttga

SEQ ID NO: 12626 - DNA, 18 bp, Artificial Sequence
  Description of Artificial Sequence: Synthetic Antisense oligonucleotide
  misc_feature (10)..(10): bicyclic nucleic acid (BNA)
  misc_feature (18)..(18): bicyclic nucleic acid (BNA)
ctgtccaagcccggttga

SEQ ID NO: 12627 - DNA, 18 bp, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
ctgtccaagcccggttga

SEQ ID NO: 12628 - DNA, 18 bp, Artificial Sequence
  Description of Artificial Sequence: Synthetic Antisense oligonucleotide
  misc_feature (11)..(11): bicyclic nucleic acid (BNA)
  misc_feature (18)..(18): bicyclic nucleic acid (BNA)
ctgtccaagcccggttga

SEQ ID NO: 12629 - DNA, 18 bp, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
ctgtccaagcccggttga

SEQ ID NO: 12630 - DNA, 18 bp, Artificial Sequence
  Description of Artificial Sequence: Synthetic Antisense oligonucleotide
  misc_feature (12)..(12): bicyclic nucleic acid (BNA)
  misc_feature (18)..(18): bicyclic nucleic acid (BNA)
ctgtccaagcccggttga

SEQ ID NO: 12631 - DNA, 18 bp, Artificial Sequence
  Description of Artificial Sequence: Synthetic Antisense oligonucleotide
  misc_feature (13)..(13): bicyclic nucleic acid (BNA)
  misc_feature (18)..(18): bicyclic nucleic acid (BNA)
ctgtccaagcccggttga

SEQ ID NO: 12632 - DNA, 18 bp, Artificial Sequence
  Description of Artificial Sequence: Synthetic Antisense oligonucleotide
  misc_feature (14)..(14): bicyclic nucleic acid (BNA)
  misc_feature (18)..(18): bicyclic nucleic acid (BNA)
ctgtccaagcccggttga

SEQ ID NO: 12633 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 12634 - DNA, 18 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 12635 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 12636 - DNA, 18 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 12637 - DNA, 18 bp, Artificial Sequence
  Description of Artificial Sequence: Synthetic Antisense oligonucleotide
  misc_feature (13)..(14): bicyclic nucleic acid (BNA)
  misc_feature (18)..(18): bicyclic nucleic acid (BNA)
ggtaagttctgtccaagc

SEQ ID NO: 12638 - DNA, 18 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 12639 - DNA, 18 bp, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 12640 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 12641 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 12642 - DNA, 18 bp, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 12643 - DNA, 18 bp, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 12644 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
ggtaagttctgtccaagc

SEQ ID NO: 12645 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (18)..(18): bicyclic nucleic acid (BNA)
ggtaagttctgtccaagc

SEQ ID NO: 12646 - DNA, 18 bp, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 12647 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
ggtaagttctgtccaagc

SEQ ID NO: 12648 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
gtaagttctgtccaagcc

SEQ ID NO: 12649 - DNA, 18 bp, Artificial Sequence
  Description of Artificial Sequence: Synthetic Antisense oligonucleotide
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12650 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
gtaagttctgtccaagcc

SEQ ID NO: 12651 - DNA, 18 bp, Artificial Sequence
  Description of Artificial Sequence: Synthetic Antisense oligonucleotide
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12652 - DNA, 18 bp, Artificial Sequence
  Description of Artificial Sequence: Synthetic Antisense oligonucleotide
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12653 - DNA, 18 bp, Artificial Sequence
  Description of Artificial Sequence: Synthetic Antisense oligonucleotide
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 12654 - DNA, 18 bp, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12655 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 12656 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 12657 - DNA, 18 bp, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 12658 - DNA, 18 bp, Artificial Sequence
  Description of Artificial Sequence: Synthetic Antisense oligonucleotide
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 12659 - DNA, 18 bp, Artificial Sequence
  Description of Artificial Sequence: Synthetic Antisense oligonucleotide
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12660 - DNA, 18 bp, Artificial Sequence
  Description of Artificial Sequence: Synthetic Antisense oligonucleotide
  misc_feature (12)..(13): bicyclic nucleic acid (BNA)
  misc_feature (18)..(18): bicyclic nucleic acid (BNA)
gtaagttctgtccaagcc

SEQ ID NO: 12661 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 12662 - DNA, 18 bp, Artificial Sequence
  Description of Artificial Sequence: Synthetic Antisense oligonucleotide
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
gtaagttctgtccaagcc

SEQ ID NO: 12663 - DNA, 18 bp, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12664 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (18)..(18): bicyclic nucleic acid (BNA)
agtcggtaagttctgtcc

SEQ ID NO: 12665 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12666 - DNA, 18 bp, Artificial Sequence
  Description of Artificial Sequence: Synthetic Antisense oligonucleotide
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12667 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12668 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12669 - DNA, 18 bp, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12670 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
agtcggtaagttctgtcc

SEQ ID NO: 12671 - DNA, 18 bp, Artificial Sequence
  Description of Artificial Sequence: Synthetic Antisense oligonucleotide
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12672 - DNA, 18 bp, Artificial Sequence
  Description of Artificial Sequence: Synthetic Antisense oligonucleotide
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12673 - DNA, 18 bp, Artificial Sequence
  Description of Artificial Sequence: Synthetic Antisense oligonucleotide
  misc_feature (5)..(6): bicyclic nucleic acid (BNA)
  misc_feature (18)..(18): bicyclic nucleic acid (BNA)
agtcggtaagttctgtcc

SEQ ID NO: 12674 - DNA, 18 bp, Artificial Sequence
  Description of Artificial Sequence: Synthetic Antisense oligonucleotide
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12675 - DNA, 18 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (18)..(18): bicyclic nucleic acid (BNA)
agtcggtaagttctgtcc

SEQ ID NO: 12676 - DNA, 18 bp, Artificial Sequence
  Description of Artificial Sequence: Synthetic Antisense oligonucleotide
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12677 - DNA, 18 bp, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12678 - DNA, 18 bp, Artificial Sequence
  Description of Artificial Sequence: Synthetic Antisense oligonucleotide
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
agtcggtaagttctgtcc

SEQ ID NO: 12679 - DNA, 18 bp, Artificial Sequence
  Description of Artificial Sequence: Synthetic Antisense oligonucleotide
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12680 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12681 - DNA, 18 bp, Artificial Sequence
  Description of Artificial Sequence: Synthetic Antisense oligonucleotide
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12682 - DNA, 18 bp, Artificial Sequence
  Description of Artificial Sequence: Synthetic Antisense oligonucleotide
  misc_feature (4)..(5): bicyclic nucleic acid (BNA)
  misc_feature (18)..(18): bicyclic nucleic acid (BNA)
agtcggtaagttctgtcc

SEQ ID NO: 12683 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12684 - DNA, 18 bp, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 12685 - DNA, 18 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12686 - DNA, 18 bp, Artificial Sequence
  Description of Artificial Sequence: Synthetic Antisense oligonucleotide
  misc_feature (11)..(12): bicyclic nucleic acid (BNA)
  misc_feature (18)..(18): bicyclic nucleic acid (BNA)
ctgtccaagcccggttga

SEQ ID NO: 12687 - DNA, 18 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 12688 - DNA, 18 bp, Artificial Sequence
  Description of Artificial Sequence: Synthetic Antisense oligonucleotide
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 12689 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12690 - DNA, 18 bp, Artificial Sequence
  Description of Artificial Sequence: Synthetic Antisense oligonucleotide
  misc_feature (9)..(10): bicyclic nucleic acid (BNA)
  misc_feature (18)..(18): bicyclic nucleic acid (BNA)
ctgtccaagcccggttga

SEQ ID NO: 12691 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12692 - DNA, 18 bp, Artificial Sequence
  Description of Artificial Sequence: Synthetic Antisense oligonucleotide
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12693 - DNA, 18 bp, Artificial Sequence
  Description of Artificial Sequence: Synthetic Antisense oligonucleotide
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
ctgtccaagcccggttga

SEQ ID NO: 12694 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 12695 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 12696 - DNA, 18 bp, Artificial Sequence
  Description of Artificial Sequence: Synthetic Antisense oligonucleotide
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 12697 - DNA, 18 bp, Artificial Sequence
  Description of Artificial Sequence: Synthetic Antisense oligonucleotide
  misc_feature (13)..(14): bicyclic nucleic acid (BNA)
  misc_feature (18)..(18): bicyclic nucleic acid (BNA)
ctgtccaagcccggttga

SEQ ID NO: 12698 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12699 - DNA, 18 bp, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12700 - DNA, 18 bp, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12701 - DNA, 18 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12702 - DNA, 18 bp, Artificial Sequence
  Description of Artificial Sequence: Synthetic Antisense oligonucleotide
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12703 - DNA, 18 bp, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12704 - DNA, 18 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12705 - DNA, 18 bp, Artificial Sequence
  Description of Artificial Sequence: Synthetic Antisense oligonucleotide
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12706 - DNA, 18 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12707 - DNA, 18 bp, Artificial Sequence
  Description of Artificial Sequence: Synthetic Antisense oligonucleotide
  misc_feature (5)..(6): bicyclic nucleic acid (BNA)
  misc_feature (18)..(18): bicyclic nucleic acid (BNA)
ctgtccaagcccggttga

SEQ ID NO: 12708 - DNA, 18 bp, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12709 - DNA, 18 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12710 - DNA, 18 bp, Artificial Sequence
  Description of Artificial Sequence: Synthetic Antisense oligonucleotide
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12711 - DNA, 18 bp, Artificial Sequence
  Description of Artificial Sequence: Synthetic Antisense oligonucleotide
  misc_feature (10)..(11): bicyclic nucleic acid (BNA)
  misc_feature (18)..(18): bicyclic nucleic acid (BNA)
ctgtccaagcccggttga

SEQ ID NO: 12712 - DNA, 18 bp, Artificial Sequence
  Description of Artificial Sequence: Synthetic Antisense oligonucleotide
  misc_feature (12)..(13): bicyclic nucleic acid (BNA)
  misc_feature (18)..(18): bicyclic nucleic acid (BNA)
ctgtccaagcccggttga

SEQ ID NO: 12713 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12714 - DNA, 18 bp, Artificial Sequence
  Description of Artificial Sequence: Synthetic Antisense oligonucleotide
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12715 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12716 - DNA, 18 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12717 - DNA, 18 bp, Artificial Sequence
  Description of Artificial Sequence: Synthetic Antisense oligonucleotide
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12718 - DNA, 18 bp, Artificial Sequence
  Description of Artificial Sequence: Synthetic Antisense oligonucleotide
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
ctgtccaagcccggttga

SEQ ID NO: 12719 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12720 - DNA, 20 bp, Artificial Sequence
  Description of Artificial Sequence: Synthetic Antisense oligonucleotide
  misc_feature (2)..(2): bicyclic nucleic acid (BNA)
  misc_feature (20)..(20): bicyclic nucleic acid (BNA)
tcaaggaagatggcatttct

SEQ ID NO: 12721 - DNA, 20 bp, Artificial Sequence
  Description of Artificial Sequence: Synthetic Antisense oligonucleotide
  misc_feature (9)..(9): bicyclic nucleic acid (BNA)
  misc_feature (20)..(20): bicyclic nucleic acid (BNA)
tcaaggaagatggcatttct

SEQ ID NO: 12722 - DNA, 20 bp, Artificial Sequence
  Description of Artificial Sequence: Synthetic Antisense oligonucleotide
  misc_feature (5)..(5): bicyclic nucleic acid (BNA)
  misc_feature (20)..(20): bicyclic nucleic acid (BNA)
tcaaggaagatggcatttct

SEQ ID NO: 12723 - DNA, 20 bp, Artificial Sequence
  Description of Artificial Sequence: Synthetic Antisense oligonucleotide
  misc_feature (6)..(6): bicyclic nucleic acid (BNA)
  misc_feature (20)..(20): bicyclic nucleic acid (BNA)
tcaaggaagatggcatttct

SEQ ID NO: 12724 - DNA, 20 bp, Artificial Sequence
  Description of Artificial Sequence: Synthetic Antisense oligonucleotide
  misc_feature (12)..(12): bicyclic nucleic acid (BNA)
  misc_feature (20)..(20): bicyclic nucleic acid (BNA)
tcaaggaagatggcatttct

SEQ ID NO: 12725 - DNA, 20 bp, Artificial Sequence
  Description of Artificial Sequence: Synthetic Antisense oligonucleotide
  misc_feature (13)..(13): bicyclic nucleic acid (BNA)
  misc_feature (20)..(20): bicyclic nucleic acid (BNA)
tcaaggaagatggcatttct

SEQ ID NO: 12726 - DNA, 20 bp, Artificial Sequence
  Description of Artificial Sequence: Synthetic Antisense oligonucleotide
  misc_feature (14)..(14): bicyclic nucleic acid (BNA)
  misc_feature (20)..(20): bicyclic nucleic acid (BNA)
tcaaggaagatggcatttct

SEQ ID NO: 12727 - DNA, 22 bp, Artificial Sequence
  Description of Artificial Sequence: Synthetic Antisense oligonucleotide
  misc_feature (2)..(2): bicyclic nucleic acid (BNA)
  misc_feature (22)..(22): bicyclic nucleic acid (BNA)
tcaaggaagatggcatttctag

SEQ ID NO: 12728 - DNA, 22 bp, Artificial Sequence
  Description of Artificial Sequence: Synthetic Antisense oligonucleotide
  misc_feature (9)..(9): bicyclic nucleic acid (BNA)
  misc_feature (22)..(22): bicyclic nucleic acid (BNA)
tcaaggaagatggcatttctag

SEQ ID NO: 12729 - DNA, 22 bp, Artificial Sequence
  Description of Artificial Sequence: Synthetic Antisense oligonucleotide
  misc_feature (5)..(5): bicyclic nucleic acid (BNA)
  misc_feature (22)..(22): bicyclic nucleic acid (BNA)
tcaaggaagatggcatttctag

SEQ ID NO: 12730 - DNA, 22 bp, Artificial Sequence
  Description of Artificial Sequence: Synthetic Antisense oligonucleotide
  misc_feature (6)..(6): bicyclic nucleic acid (BNA)
  misc_feature (22)..(22): bicyclic nucleic acid (BNA)
tcaaggaagatggcatttctag

SEQ ID NO: 12731 - DNA, 22 bp, Artificial Sequence
  Description of Artificial Sequence: Synthetic Antisense oligonucleotide
  misc_feature (12)..(12): bicyclic nucleic acid (BNA)
  misc_feature (22)..(22): bicyclic nucleic acid (BNA)
tcaaggaagatggcatttctag

SEQ ID NO: 12732 - DNA, 22 bp, Artificial Sequence
  Description of Artificial Sequence: Synthetic Antisense oligonucleotide
  misc_feature (13)..(13): bicyclic nucleic acid (BNA)
  misc_feature (22)..(22): bicyclic nucleic acid (BNA)
tcaaggaagatggcatttctag

SEQ ID NO: 12733 - DNA, 22 bp, Artificial Sequence
  Description of Artificial Sequence: Synthetic Antisense oligonucleotide
  misc_feature (19)..(19): bicyclic nucleic acid (BNA)
  misc_feature (22)..(22): bicyclic nucleic acid (BNA)
tcaaggaagatggcatttctag

SEQ ID NO: 12734 - DNA, 22 bp, Artificial Sequence
  Description of Artificial Sequence: Synthetic Antisense oligonucleotide
  misc_feature (14)..(14): bicyclic nucleic acid (BNA)
  misc_feature (22)..(22): bicyclic nucleic acid (BNA)
tcaaggaagatggcatttctag

SEQ ID NO: 12735 - DNA, 20 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12736 - DNA, 20 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 12737 - DNA, 20 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12738 - DNA, 20 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12739 - DNA, 20 bp, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12740 - DNA, 20 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 12741 - DNA, 20 bp, Artificial Sequence
  Description of Artificial Sequence: Synthetic Antisense oligonucleotide
  misc_feature (13)..(14): bicyclic nucleic acid (BNA)
  misc_feature (20)..(20): bicyclic nucleic acid (BNA)
tcaaggaagatggcatttct

SEQ ID NO: 12742 - DNA, 20 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12743 - DNA, 20 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12744 - DNA, 20 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (20)..(20): bicyclic nucleic acid (BNA)
tcaaggaagatggcatttct

SEQ ID NO: 12745 - DNA, 20 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12746 - DNA, 20 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12747 - DNA, 20 bp, Artificial Sequence
  Description of Artificial Sequence: Synthetic Antisense oligonucleotide
  misc_feature (5)..(6): bicyclic nucleic acid (BNA)
  misc_feature (20)..(20): bicyclic nucleic acid (BNA)
tcaaggaagatggcatttct

SEQ ID NO: 12748 - DNA, 20 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12749 - DNA, 20 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12750 - DNA, 20 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (20)..(20): bicyclic nucleic acid (BNA)
tcaaggaagatggcatttct

SEQ ID NO: 12751 - DNA, 20 bp, Artificial Sequence
  Description of Artificial Sequence: Synthetic Antisense oligonucleotide
  misc_feature (12)..(13): bicyclic nucleic acid (BNA)
  misc_feature (20)..(20): bicyclic nucleic acid (BNA)
tcaaggaagatggcatttct

SEQ ID NO: 12752 - DNA, 20 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12753 - DNA, 20 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12754 - DNA, 20 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12755 - DNA, 20 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 12756 - DNA, 22 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12757 - DNA, 22 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 12758 - DNA, 22 bp, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12759 - DNA, 22 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12760 - DNA, 22 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12761 - DNA, 22 bp, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12762 - DNA, 22 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 12763 - DNA, 22 bp, Artificial Sequence
  Description of Artificial Sequence: Synthetic Antisense oligonucleotide
  misc_feature (13)..(14): bicyclic nucleic acid (BNA)
  misc_feature (22)..(22): bicyclic nucleic acid (BNA)
tcaaggaagatggcatttctag

SEQ ID NO: 12764 - DNA, 22 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12765 - DNA, 22 bp, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12766 - DNA, 22 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12767 - DNA, 22 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (22)..(22): bicyclic nucleic acid (BNA)
tcaaggaagatggcatttctag

SEQ ID NO: 12768 - DNA, 22 bp, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12769 - DNA, 22 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12770 - DNA, 22 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12771 - DNA, 22 bp, Artificial Sequence
  Description of Artificial Sequence: Synthetic Antisense oligonucleotide
  misc_feature (5)..(6): bicyclic nucleic acid (BNA)
  misc_feature (22)..(22): bicyclic nucleic acid (BNA)
tcaaggaagatggcatttctag

SEQ ID NO: 12772 - DNA, 22 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12773 - DNA, 22 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12774 - DNA, 22 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (22)..(22): bicyclic nucleic acid (BNA)
tcaaggaagatggcatttctag

SEQ ID NO: 12775 - DNA, 22 bp, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12776 - DNA, 22 bp, Artificial Sequence
  Description of Artificial Sequence: Synthetic Antisense oligonucleotide
  misc_feature (12)..(13): bicyclic nucleic acid (BNA)
  misc_feature (22)..(22): bicyclic nucleic acid (BNA)
tcaaggaagatggcatttctag

SEQ ID NO: 12777 - DNA, 22 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12778 - DNA, 22 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12779 - DNA, 22 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12780 - DNA, 22 bp, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12781 - DNA, 22 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 12782 - DNA, 22 bp, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12783 - DNA, 22 bp, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12784 - DNA, 18 bp, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12785 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (18)..(18): bicyclic nucleic acid (BNA)
ggtaagttctgtccaagc

SEQ ID NO: 12786 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (18)..(18): bicyclic nucleic acid (BNA)
ggtaagttctgtccaagc

SEQ ID NO: 12787 - DNA, 18 bp, Artificial Sequence
  Description of Artificial Sequence: Synthetic Antisense oligonucleotide
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12788 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
  misc_feature (18)..(18): bicyclic nucleic acid (BNA)
ggtaagttctgtccaagc

SEQ ID NO: 12789 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
  misc_feature (18)..(18): bicyclic nucleic acid (BNA)
ggtaagttctgtccaagc

SEQ ID NO: 12790 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(16): bicyclic nucleic acid (BNA)
  misc_feature (18)..(18): bicyclic nucleic acid (BNA)
gtaagttctgtccaagcc

SEQ ID NO: 12791 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (18)..(18): bicyclic nucleic acid (BNA)
gtaagttctgtccaagcc

SEQ ID NO: 12792 - DNA, 18 bp, Artificial Sequence
  Description of Artificial Sequence: Synthetic Antisense oligonucleotide
  misc_feature (5)..(5): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12793 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (18)..(18): bicyclic nucleic acid (BNA)
gtaagttctgtccaagcc

SEQ ID NO: 12794 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (18)..(18): bicyclic nucleic acid (BNA)
gtaagttctgtccaagcc

SEQ ID NO: 12795 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (18)..(18): bicyclic nucleic acid (BNA)
gtaagttctgtccaagcc

SEQ ID NO: 12796 - DNA, 18 bp, Artificial Sequence
  Description of Artificial Sequence: Synthetic Antisense oligonucleotide
  misc_feature (2)..(2): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12797 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (18)..(18): bicyclic nucleic acid (BNA)
agtcggtaagttctgtcc

SEQ ID NO: 12798 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (18)..(18): bicyclic nucleic acid (BNA)
agtcggtaagttctgtcc

SEQ ID NO: 12799 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (18)..(18): bicyclic nucleic acid (BNA)
agtcggtaagttctgtcc

SEQ ID NO: 12800 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (18)..(18): bicyclic nucleic acid (BNA)
agtcggtaagttctgtcc

SEQ ID NO: 12801 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (18)..(18): bicyclic nucleic acid (BNA)
agtcggtaagttctgtcc

SEQ ID NO: 12802 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
  misc_feature (18)..(18): bicyclic nucleic acid (BNA)
agtcggtaagttctgtcc

SEQ ID NO: 12803 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (18)..(18): bicyclic nucleic acid (BNA)
ctgtccaagcccggttga

SEQ ID NO: 12804 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (18)..(18): bicyclic nucleic acid (BNA)
ctgtccaagcccggttga

SEQ ID NO: 12805 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (18)..(18): bicyclic nucleic acid (BNA)
ctgtccaagcccggttga

SEQ ID NO: 12806 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (18)..(18): bicyclic nucleic acid (BNA)
ctgtccaagcccggttga

SEQ ID NO: 12807 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (18)..(18): bicyclic nucleic acid (BNA)
ctgtccaagcccggttga

SEQ ID NO: 12808 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (18)..(18): bicyclic nucleic acid (BNA)
ctgtccaagcccggttga

SEQ ID NO: 12809 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (18)..(18): bicyclic nucleic acid (BNA)
ctgtccaagcccggttga

SEQ ID NO: 12810 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
  misc_feature (18)..(18): bicyclic nucleic acid (BNA)
ctgtccaagcccggttga

SEQ ID NO: 12811 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
  misc_feature (18)..(18): bicyclic nucleic acid (BNA)
ctgtccaagcccggttga

SEQ ID NO: 12812 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12813 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 12814 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12815 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 12816 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(14): bicyclic nucleic acid (BNA)
  misc_feature (18)..(18): bicyclic nucleic acid (BNA)
ggtaagttctgtccaagc

SEQ ID NO: 12817 - DNA, 18 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12818 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 12819 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12820 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12821 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 12822 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 12823 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12824 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12825 - DNA, 18 bp, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12826 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 12827 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12828 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12829 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12830 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12831 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12832 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 12833 - DNA, 18 bp, Artificial Sequence
  Description of Artificial Sequence: Synthetic Antisense oligonucleotide
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12834 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 12835 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12836 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 12837 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 12838 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 12839 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(13): bicyclic nucleic acid (BNA)
  misc_feature (18)..(18): bicyclic nucleic acid (BNA)
gtaagttctgtccaagcc

SEQ ID NO: 12840 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 12841 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
gtaagttctgtccaagcc

SEQ ID NO: 12842 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12843 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12844 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12845 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12846 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12847 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12848 - DNA, 18 bp, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12849 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12850 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12851 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12852 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(6): bicyclic nucleic acid (BNA)
  misc_feature (18)..(18): bicyclic nucleic acid (BNA)
agtcggtaagttctgtcc

SEQ ID NO: 12853 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12854 - DNA, 18 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12855 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 12856 - DNA, 18 bp, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12857 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
agtcggtaagttctgtcc

SEQ ID NO: 12858 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12859 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 12860 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 12861 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(5): bicyclic nucleic acid (BNA)
  misc_feature (18)..(18): bicyclic nucleic acid (BNA)
agtcggtaagttctgtcc

SEQ ID NO: 12862 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 12863 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 12864 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12865 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
  misc_feature (18)..(18): bicyclic nucleic acid (BNA)
ctgtccaagcccggttga

SEQ ID NO: 12866 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 12867 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 12868 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12869 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(10): bicyclic nucleic acid (BNA)
  misc_feature (18)..(18): bicyclic nucleic acid (BNA)
ctgtccaagcccggttga

SEQ ID NO: 12870 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12871 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12872 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
ctgtccaagcccggttga

SEQ ID NO: 12873 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 12874 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 12875 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 12876 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
  misc_feature (18)..(18): bicyclic nucleic acid (BNA)
ctgtccaagcccggttga

SEQ ID NO: 12877 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12878 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12879 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12880 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12881 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12882 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12883 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12884 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12885 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12886 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(6): bicyclic nucleic acid (BNA)
  misc_feature (18)..(18): bicyclic nucleic acid (BNA)
ctgtccaagcccggttga

SEQ ID NO: 12887 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12888 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12889 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12890 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(11): bicyclic nucleic acid (BNA)
  misc_feature (18)..(18): bicyclic nucleic acid (BNA)
ctgtccaagcccggttga

SEQ ID NO: 12891 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
  misc_feature (18)..(18): bicyclic nucleic acid (BNA)
ctgtccaagcccggttga

SEQ ID NO: 12892 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12893 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 12894 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 12895 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12896 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 12897 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
ctgtccaagcccggttga

SEQ ID NO: 12898 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 12899 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (20)..(20): bicyclic nucleic acid (BNA)
tcaaggaagatggcatttct

SEQ ID NO: 12900 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (20)..(20): bicyclic nucleic acid (BNA)
tcaaggaagatggcatttct

SEQ ID NO: 12901 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (20)..(20): bicyclic nucleic acid (BNA)
tcaaggaagatggcatttct

SEQ ID NO: 12902 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (20)..(20): bicyclic nucleic acid (BNA)
tcaaggaagatggcatttct

SEQ ID NO: 12903 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (20)..(20): bicyclic nucleic acid (BNA)
tcaaggaagatggcatttct

SEQ ID NO: 12904 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (20)..(20): bicyclic nucleic acid (BNA)
tcaaggaagatggcatttct

SEQ ID NO: 12905 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (20)..(20): bicyclic nucleic acid (BNA)
tcaaggaagatggcatttct

SEQ ID NO: 12906 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (22)..(22): bicyclic nucleic acid (BNA)
tcaaggaagatggcatttctag

SEQ ID NO: 12907 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (22)..(22): bicyclic nucleic acid (BNA)
tcaaggaagatggcatttctag

SEQ ID NO: 12908 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (22)..(22): bicyclic nucleic acid (BNA)
tcaaggaagatggcatttctag

SEQ ID NO: 12909 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (22)..(22): bicyclic nucleic acid (BNA)
tcaaggaagatggcatttctag

SEQ ID NO: 12910 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (22)..(22): bicyclic nucleic acid (BNA)
tcaaggaagatggcatttctag

SEQ ID NO: 12911 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (22)..(22): bicyclic nucleic acid (BNA)
tcaaggaagatggcatttctag

SEQ ID NO: 12912 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
  misc_feature (22)..(22): bicyclic nucleic acid (BNA)
tcaaggaagatggcatttctag

SEQ ID NO: 12913 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (22)..(22): bicyclic nucleic acid (BNA)
tcaaggaagatggcatttctag

SEQ ID NO: 12914 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12915 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 12916 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12917 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12918 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12919 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 12920 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (20)..(20): bicyclic nucleic acid (BNA)
tcaaggaagatggcatttct

SEQ ID NO: 12921 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12922 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12923 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (20)..(20): bicyclic nucleic acid (BNA)
tcaaggaagatggcatttct

SEQ ID NO: 12924 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12925 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12926 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (20)..(20): bicyclic nucleic acid (BNA)
tcaaggaagatggcatttct

SEQ ID NO: 12927 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 12928 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12929 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (20)..(20): bicyclic nucleic acid (BNA)
tcaaggaagatggcatttct

SEQ ID NO: 12930 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (20)..(20): bicyclic nucleic acid (BNA)
tcaaggaagatggcatttct

SEQ ID NO: 12931 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 12932 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12933 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 12934 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 12935 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12936 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 12937 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12938 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12939 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12940 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12941 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 12942 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (22)..(22): bicyclic nucleic acid (BNA)
tcaaggaagatggcatttctag

SEQ ID NO: 12943 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12944 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12945 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12946 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (22)..(22): bicyclic nucleic acid (BNA)
tcaaggaagatggcatttctag

SEQ ID NO: 12947 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12948 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12949 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12950 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (22)..(22): bicyclic nucleic acid (BNA)
tcaaggaagatggcatttctag

SEQ ID NO: 12951 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 12952 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12953 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (22)..(22): bicyclic nucleic acid (BNA)
tcaaggaagatggcatttctag

SEQ ID NO: 12954 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12955 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (22)..(22): bicyclic nucleic acid (BNA)
tcaaggaagatggcatttctag

SEQ ID NO: 12956 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 12957 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12958 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 12959 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12960 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 12961 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12962 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 12963 - RNA, 18 nt, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
gguaaguucuguccaagc

SEQ ID NO: 12964 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
gguaaguucuguccaagc

SEQ ID NO: 12965 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 12966 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
gguaaguucuguccaagc

SEQ ID NO: 12967 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
gguaaguucuguccaagc

SEQ ID NO: 12968 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 12969 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12970 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 12971 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
guaaguucuguccaagcc

SEQ ID NO: 12972 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
guaaguucuguccaagcc

SEQ ID NO: 12973 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
guaaguucuguccaagcc

SEQ ID NO: 12974 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 12975 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 12976 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (18)..(18): bicyclic nucleic acid (BNA)
guaaguucuguccaagcc

SEQ ID NO: 12977 - RNA, 18 nt, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
agucgguaaguucugucc

SEQ ID NO: 12978 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (18)..(18): bicyclic nucleic acid (BNA)
agucgguaaguucugucc

SEQ ID NO: 12979 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 12980 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
agucgguaaguucugucc

SEQ ID NO: 12981 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
agucgguaaguucugucc

SEQ ID NO: 12982 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
agucgguaaguucugucc

SEQ ID NO: 12983 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 12984 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 12985 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (18)..(18): bicyclic nucleic acid (BNA)
cuguccaagcccgguuga

SEQ ID NO: 12986 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 12987 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 12988 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
cuguccaagcccgguuga

SEQ ID NO: 12989 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 12990 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
cuguccaagcccgguuga

SEQ ID NO: 12991 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
cuguccaagcccgguuga

SEQ ID NO: 12992 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 12993 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 12994 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 12995 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12996 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 12997 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 12998 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
gguaaguucuguccaagc

SEQ ID NO: 12999 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
gguaaguucuguccaagc

SEQ ID NO: 13000 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gguaaguucuguccaagc

SEQ ID NO: 13001 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 13002 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 13003 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 13004 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 13005 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
gguaaguucuguccaagc

SEQ ID NO: 13006 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 13007 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
gguaaguucuguccaagc

SEQ ID NO: 13008 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 13009 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
gguaaguucuguccaagc

SEQ ID NO: 13010 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 13011 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 13012 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
gguaaguucuguccaagc

SEQ ID NO: 13013 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
gguaaguucuguccaagc

SEQ ID NO: 13014 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 13015 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (18)..(18): bicyclic nucleic acid (BNA)
gguaaguucuguccaagc

SEQ ID NO: 13016 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
guaaguucuguccaagcc

SEQ ID NO: 13017 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
guaaguucuguccaagcc

SEQ ID NO: 13018 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 13019 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 13020 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(18): bicyclic nucleic acid (BNA)
guaaguucuguccaagcc

SEQ ID NO: 13021 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
guaaguucuguccaagcc

SEQ ID NO: 13022 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 13023 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
guaaguucuguccaagcc

SEQ ID NO: 13024 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 13025 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 13026 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 13027 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
guaaguucuguccaagcc

SEQ ID NO: 13028 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
guaaguucuguccaagcc

SEQ ID NO: 13029 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
guaaguucuguccaagcc

SEQ ID NO: 13030 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
guaaguucuguccaagcc

SEQ ID NO: 13031 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
guaaguucuguccaagcc

SEQ ID NO: 13032 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 13033 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 13034 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
guaaguucuguccaagcc

SEQ ID NO: 13035 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(18): bicyclic nucleic acid (BNA)
guaaguucuguccaagcc

SEQ ID NO: 13036 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
guaaguucuguccaagcc

SEQ ID NO: 13037 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 13038 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (18)..(18): bicyclic nucleic acid (BNA)
agucgguaaguucugucc

SEQ ID NO: 13039 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 13040 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 13041 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 13042 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 13043 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
agucgguaaguucugucc

SEQ ID NO: 13044 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 13045 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 13046 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
agucgguaaguucugucc

SEQ ID NO: 13047 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(18): bicyclic nucleic acid (BNA)
agucgguaaguucugucc

SEQ ID NO: 13048 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 13049 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 13050 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
agucgguaaguucugucc

SEQ ID NO: 13051 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 13052 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (18)..(18): bicyclic nucleic acid (BNA)
agucgguaaguucugucc

SEQ ID NO: 13053 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
agucgguaaguucugucc

SEQ ID NO: 13054 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 13055 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 13056 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 13057 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
agucgguaaguucugucc

SEQ ID NO: 13058 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 13059 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 13060 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 13061 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
agucgguaaguucugucc

SEQ ID NO: 13062 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
agucgguaaguucugucc

SEQ ID NO: 13063 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
  misc_feature (18)..(18): bicyclic nucleic acid (BNA)
agucgguaaguucugucc

SEQ ID NO: 13064 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 13065 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 13066 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13067 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13068 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(12): bicyclic nucleic acid (BNA)
  misc_feature (18)..(18): bicyclic nucleic acid (BNA)
cuguccaagcccgguuga

SEQ ID NO: 13069 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13070 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13071 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13072 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(10): bicyclic nucleic acid (BNA)
  misc_feature (18)..(18): bicyclic nucleic acid (BNA)
cuguccaagcccgguuga

SEQ ID NO: 13073 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13074 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13075 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 13076 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
cuguccaagcccgguuga

SEQ ID NO: 13077 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13078 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13079 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13080 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
cuguccaagcccgguuga

SEQ ID NO: 13081 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13082 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13083 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 13084 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13085 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13086 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13087 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13088 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 13089 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13090 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13091 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (17)..(18): bicyclic nucleic acid (BNA)
cuguccaagcccgguuga

SEQ ID NO: 13092 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13093 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
cuguccaagcccgguuga

SEQ ID NO: 13094 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13095 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13096 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
cuguccaagcccgguuga

SEQ ID NO: 13097 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13098 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(11): bicyclic nucleic acid (BNA)
  misc_feature (18)..(18): bicyclic nucleic acid (BNA)
cuguccaagcccgguuga

SEQ ID NO: 13099 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 13100 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
cuguccaagcccgguuga

SEQ ID NO: 13101 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13102 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13103 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13104 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
cuguccaagcccgguuga

SEQ ID NO: 13105 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13106 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 13107 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13108 - RNA, 18 nt, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
cuguccaagcccgguuga

SEQ ID NO: 13109 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13110 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(20): bicyclic nucleic acid (BNA)
tcaaggaagauggcauuuct

SEQ ID NO: 13111 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
tcaaggaagauggcauuuct

SEQ ID NO: 13112 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (20)..(20): bicyclic nucleic acid (BNA)
tcaaggaagauggcauuuct

SEQ ID NO: 13113 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (20)..(20): bicyclic nucleic acid (BNA)
tcaaggaagauggcauuuct

SEQ ID NO: 13114 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (20)..(20): bicyclic nucleic acid (BNA)
tcaaggaagauggcauuuct

SEQ ID NO: 13115 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 13116 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(20): bicyclic nucleic acid (BNA)
tcaaggaagauggcauuuct

SEQ ID NO: 13117 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (20)..(20): bicyclic nucleic acid (BNA)
tcaaggaagauggcauuuct

SEQ ID NO: 13118 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(22): bicyclic nucleic acid (BNA)
tcaaggaagauggcauuucuag

SEQ ID NO: 13119 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (22)..(22): bicyclic nucleic acid (BNA)
tcaaggaagauggcauuucuag

SEQ ID NO: 13120 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (22)..(22): bicyclic nucleic acid (BNA)
tcaaggaagauggcauuucuag

SEQ ID NO: 13121 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (22)..(22): bicyclic nucleic acid (BNA)
tcaaggaagauggcauuucuag

SEQ ID NO: 13122 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (22)..(22): bicyclic nucleic acid (BNA)
tcaaggaagauggcauuucuag

SEQ ID NO: 13123 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 13124 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13125 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (22)..(22): bicyclic nucleic acid (BNA)
tcaaggaagauggcauuucuag

SEQ ID NO: 13126 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
tcaaggaagauggcauuuct

SEQ ID NO: 13127 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
tcaaggaagauggcauuuct

SEQ ID NO: 13128 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(20): bicyclic nucleic acid (BNA)
tcaaggaagauggcauuuct

SEQ ID NO: 13129 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
tcaaggaagauggcauuuct

SEQ ID NO: 13130 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 13131 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (20)..(20): bicyclic nucleic acid (BNA)
tcaaggaagauggcauuuct

SEQ ID NO: 13132 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
tcaaggaagauggcauuuct

SEQ ID NO: 13133 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
  misc_feature (20)..(20): bicyclic nucleic acid (BNA)
tcaaggaagauggcauuuct

SEQ ID NO: 13134 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 13135 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(20): bicyclic nucleic acid (BNA)
tcaaggaagauggcauuuct

SEQ ID NO: 13136 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
tcaaggaagauggcauuuct

SEQ ID NO: 13137 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (20)..(20): bicyclic nucleic acid (BNA)
tcaaggaagauggcauuuct

SEQ ID NO: 13138 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(20): bicyclic nucleic acid (BNA)
tcaaggaagauggcauuuct

SEQ ID NO: 13139 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
tcaaggaagauggcauuuct

SEQ ID NO: 13140 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
tcaaggaagauggcauuuct

SEQ ID NO: 13141 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
  misc_feature (20)..(20): bicyclic nucleic acid (BNA)
tcaaggaagauggcauuuct

SEQ ID NO: 13142 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (20)..(20): bicyclic nucleic acid (BNA)
tcaaggaagauggcauuuct

SEQ ID NO: 13143 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
tcaaggaagauggcauuuct

SEQ ID NO: 13144 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (20)..(20): bicyclic nucleic acid (BNA)
tcaaggaagauggcauuuct

SEQ ID NO: 13145 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(20): bicyclic nucleic acid (BNA)
tcaaggaagauggcauuuct

SEQ ID NO: 13146 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
  misc_feature (20)..(20): bicyclic nucleic acid (BNA)
tcaaggaagauggcauuuct

SEQ ID NO: 13147 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
tcaaggaagauggcauuuct

SEQ ID NO: 13148 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 13149 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 13150 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
tcaaggaagauggcauuuct

SEQ ID NO: 13151 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (20)..(20): bicyclic nucleic acid (BNA)
tcaaggaagauggcauuuct

SEQ ID NO: 13152 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(20): bicyclic nucleic acid (BNA)
tcaaggaagauggcauuuct

SEQ ID NO: 13153 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(20): bicyclic nucleic acid (BNA)
tcaaggaagauggcauuuct

SEQ ID NO: 13154 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
tcaaggaagauggcauuucuag

SEQ ID NO: 13155 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
tcaaggaagauggcauuucuag

SEQ ID NO: 13156 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13157 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
tcaaggaagauggcauuucuag

SEQ ID NO: 13158 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 13159 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (22)..(22): bicyclic nucleic acid (BNA)
tcaaggaagauggcauuucuag

SEQ ID NO: 13160 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
tcaaggaagauggcauuucuag

SEQ ID NO: 13161 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
  misc_feature (22)..(22): bicyclic nucleic acid (BNA)
tcaaggaagauggcauuucuag

SEQ ID NO: 13162 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 13163 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13164 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
tcaaggaagauggcauuucuag

SEQ ID NO: 13165 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (22)..(22): bicyclic nucleic acid (BNA)
tcaaggaagauggcauuucuag

SEQ ID NO: 13166 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13167 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
tcaaggaagauggcauuucuag

SEQ ID NO: 13168 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
tcaaggaagauggcauuucuag

SEQ ID NO: 13169 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
  misc_feature (22)..(22): bicyclic nucleic acid (BNA)
tcaaggaagauggcauuucuag

SEQ ID NO: 13170 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (22)..(22): bicyclic nucleic acid (BNA)
tcaaggaagauggcauuucuag

SEQ ID NO: 13171 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
tcaaggaagauggcauuucuag

SEQ ID NO: 13172 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (22)..(22): bicyclic nucleic acid (BNA)
tcaaggaagauggcauuucuag

SEQ ID NO: 13173 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13174 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
  misc_feature (22)..(22): bicyclic nucleic acid (BNA)
tcaaggaagauggcauuucuag

SEQ ID NO: 13175 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
tcaaggaagauggcauuucuag

SEQ ID NO: 13176 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 13177 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 13178 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13179 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
tcaaggaagauggcauuucuag

SEQ ID NO: 13180 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13181 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
tcaaggaagauggcauuucuag

SEQ ID NO: 13182 - RNA, 18 nt, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13183 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13184 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13185 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13186 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13187 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13188 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13189 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13190 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13191 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13192 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13193 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13194 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13195 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13196 - RNA, 18 nt, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13197 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13198 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13199 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13200 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13201 - RNA, 18 nt, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13202 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13203 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13204 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (18)..(18): bicyclic nucleic acid (BNA)
cuguccaagcccgguuga

SEQ ID NO: 13205 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13206 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13207 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
cuguccaagcccgguuga

SEQ ID NO: 13208 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13209 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
cuguccaagcccgguuga

SEQ ID NO: 13210 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (17)..(18): bicyclic nucleic acid (BNA)
cuguccaagcccgguuga

SEQ ID NO: 13211 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13212 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13213 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13214 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13215 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13216 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13217 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13218 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13219 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13220 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13221 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13222 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13223 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13224 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13225 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13226 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13227 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13228 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13229 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13230 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13231 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13232 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13233 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13234 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 13235 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13236 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13237 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13238 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13239 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13240 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13241 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13242 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13243 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13244 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13245 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13246 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13247 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13248 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13249 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13250 - RNA, 18 nt, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13251 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13252 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13253 - RNA, 18 nt, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13254 - RNA, 18 nt, Artificial Sequence
  Description of Artificial Sequence: Synthetic Antisense oligonucleotide
  misc_feature (1)..(1): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13255 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 13256 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13257 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13258 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13259 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13260 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13261 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13262 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13263 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13264 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13265 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13266 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13267 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13268 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13269 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13270 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13271 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13272 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13273 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13274 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13275 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13276 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13277 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13278 - RNA, 18 nt, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13279 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13280 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13281 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13282 - RNA, 18 nt, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13283 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 13284 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 13285 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13286 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13287 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(12): bicyclic nucleic acid (BNA)
  misc_feature (18)..(18): bicyclic nucleic acid (BNA)
cuguccaagcccgguuga

SEQ ID NO: 13288 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13289 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13290 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13291 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(10): bicyclic nucleic acid (BNA)
  misc_feature (18)..(18): bicyclic nucleic acid (BNA)
cuguccaagcccgguuga

SEQ ID NO: 13292 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13293 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13294 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 13295 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
cuguccaagcccgguuga

SEQ ID NO: 13296 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 13297 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13298 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
cuguccaagcccgguuga

SEQ ID NO: 13299 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
cuguccaagcccgguuga

SEQ ID NO: 13300 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13301 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13302 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 13303 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13304 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13305 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13306 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13307 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 13308 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13309 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13310 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (17)..(18): bicyclic nucleic acid (BNA)
cuguccaagcccgguuga

SEQ ID NO: 13311 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13312 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
cuguccaagcccgguuga

SEQ ID NO: 13313 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13314 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13315 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
cuguccaagcccgguuga

SEQ ID NO: 13316 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13317 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(11): bicyclic nucleic acid (BNA)
  misc_feature (18)..(18): bicyclic nucleic acid (BNA)
cuguccaagcccgguuga

SEQ ID NO: 13318 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 13319 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
cuguccaagcccgguuga

SEQ ID NO: 13320 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13321 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 13322 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
cuguccaagcccgguuga

SEQ ID NO: 13323 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
cuguccaagcccgguuga

SEQ ID NO: 13324 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13325 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 13326 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
cuguccaagcccgguuga

SEQ ID NO: 13327 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
cuguccaagcccgguuga

SEQ ID NO: 13328 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 13329 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13330 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13331 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13332 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13333 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13334 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13335 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13336 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13337 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13338 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13339 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13340 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13341 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13342 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13343 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13344 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13345 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13346 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13347 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13348 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13349 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13350 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13351 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13352 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13353 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13354 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13355 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13356 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13357 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13358 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13359 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13360 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13361 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13362 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13363 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13364 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13365 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13366 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13367 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13368 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13369 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13370 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13371 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13372 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 13373 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13374 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13375 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13376 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13377 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13378 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13379 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13380 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13381 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13382 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13383 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13384 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13385 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13386 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13387 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13388 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(6): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13389 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13390 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13391 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13392 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13393 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (12)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13394 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13395 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13396 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13397 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13398 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13399 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13400 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 13401 - DNA, 18 bp, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
ggtaagttctgtccaagc

SEQ ID NO: 13402 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
ggtaagttctgtccaagc

SEQ ID NO: 13403 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 13404 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
ggtaagttctgtccaagc

SEQ ID NO: 13405 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
ggtaagttctgtccaagc

SEQ ID NO: 13406 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 13407 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 13408 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 13409 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
gtaagttctgtccaagcc

SEQ ID NO: 13410 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
gtaagttctgtccaagcc

SEQ ID NO: 13411 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
gtaagttctgtccaagcc

SEQ ID NO: 13412 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 13413 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 13414 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (18)..(18): bicyclic nucleic acid (BNA)
gtaagttctgtccaagcc

SEQ ID NO: 13415 - DNA, 18 bp, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
agtcggtaagttctgtcc

SEQ ID NO: 13416 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (18)..(18): bicyclic nucleic acid (BNA)
agtcggtaagttctgtcc

SEQ ID NO: 13417 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 13418 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
agtcggtaagttctgtcc

SEQ ID NO: 13419 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
agtcggtaagttctgtcc

SEQ ID NO: 13420 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
agtcggtaagttctgtcc

SEQ ID NO: 13421 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 13422 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13423 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (18)..(18): bicyclic nucleic acid (BNA)
ctgtccaagcccggttga

SEQ ID NO: 13424 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13425 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13426 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
ctgtccaagcccggttga

SEQ ID NO: 13427 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13428 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
ctgtccaagcccggttga

SEQ ID NO: 13429 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
ctgtccaagcccggttga

SEQ ID NO: 13430 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13431 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13432 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13433 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 13434 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 13435 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 13436 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
ggtaagttctgtccaagc

SEQ ID NO: 13437 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
ggtaagttctgtccaagc

SEQ ID NO: 13438 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ggtaagttctgtccaagc

SEQ ID NO: 13439 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 13440 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 13441 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 13442 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 13443 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
ggtaagttctgtccaagc

SEQ ID NO: 13444 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 13445 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
ggtaagttctgtccaagc

SEQ ID NO: 13446 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 13447 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ggtaagttctgtccaagc

SEQ ID NO: 13448 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 13449 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 13450 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ggtaagttctgtccaagc

SEQ ID NO: 13451 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
ggtaagttctgtccaagc

SEQ ID NO: 13452 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 13453 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (18)..(18): bicyclic nucleic acid (BNA)
ggtaagttctgtccaagc

SEQ ID NO: 13454 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 13455 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
gtaagttctgtccaagcc

SEQ ID NO: 13456 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 13457 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 13458 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(18): bicyclic nucleic acid (BNA)
gtaagttctgtccaagcc

SEQ ID NO: 13459 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 13460 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 13461 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
gtaagttctgtccaagcc

SEQ ID NO: 13462 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 13463 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 13464 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 13465 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
gtaagttctgtccaagcc

SEQ ID NO: 13466 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 13467 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
gtaagttctgtccaagcc

SEQ ID NO: 13468 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
gtaagttctgtccaagcc

SEQ ID NO: 13469 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
gtaagttctgtccaagcc

SEQ ID NO: 13470 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 13471 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 13472 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
gtaagttctgtccaagcc

SEQ ID NO: 13473 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(18): bicyclic nucleic acid (BNA)
gtaagttctgtccaagcc

SEQ ID NO: 13474 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
gtaagttctgtccaagcc

SEQ ID NO: 13475 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 13476 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (18)..(18): bicyclic nucleic acid (BNA)
agtcggtaagttctgtcc

SEQ ID NO: 13477 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 13478 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 13479 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13480 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 13481 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
agtcggtaagttctgtcc

SEQ ID NO: 13482 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 13483 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13484 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
agtcggtaagttctgtcc

SEQ ID NO: 13485 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(18): bicyclic nucleic acid (BNA)
agtcggtaagttctgtcc

SEQ ID NO: 13486 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13487 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13488 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
agtcggtaagttctgtcc

SEQ ID NO: 13489 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13490 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (18)..(18): bicyclic nucleic acid (BNA)
agtcggtaagttctgtcc

SEQ ID NO: 13491 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
agtcggtaagttctgtcc

SEQ ID NO: 13492 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 13493 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 13494 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 13495 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
agtcggtaagttctgtcc

SEQ ID NO: 13496 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 13497 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 13498 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 13499 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
agtcggtaagttctgtcc

SEQ ID NO: 13500 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
agtcggtaagttctgtcc

SEQ ID NO: 13501 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
  misc_feature (18)..(18): bicyclic nucleic acid (BNA)
agtcggtaagttctgtcc

SEQ ID NO: 13502 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 13503 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 13504 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13505 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13506 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(12): bicyclic nucleic acid (BNA)
  misc_feature (18)..(18): bicyclic nucleic acid (BNA)
ctgtccaagcccggttga

SEQ ID NO: 13507 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13508 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13509 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13510 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(10): bicyclic nucleic acid (BNA)
  misc_feature (18)..(18): bicyclic nucleic acid (BNA)
ctgtccaagcccggttga

SEQ ID NO: 13511 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13512 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13513 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 13514 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
ctgtccaagcccggttga

SEQ ID NO: 13515 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13516 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13517 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13518 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
ctgtccaagcccggttga

SEQ ID NO: 13519 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13520 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13521 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 13522 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13523 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13524 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13525 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13526 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 13527 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13528 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13529 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (17)..(18): bicyclic nucleic acid (BNA)
ctgtccaagcccggttga

SEQ ID NO: 13530 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13531 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
ctgtccaagcccggttga

SEQ ID NO: 13532 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13533 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13534 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 13535 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13536 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(11): bicyclic nucleic acid (BNA)
  misc_feature (18)..(18): bicyclic nucleic acid (BNA)
ctgtccaagcccggttga

SEQ ID NO: 13537 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 13538 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
ctgtccaagcccggttga

SEQ ID NO: 13539 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13540 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13541 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13542 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 13543 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13544 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 13545 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13546 - DNA, 18 bp, Artificial Sequence
  Description of Artificial Sequence: Synthetic Antisense oligonucleotide
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
ctgtccaagcccggttga

SEQ ID NO: 13547 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13548 - DNA, 20 bp, Artificial Sequence
  Description of Artificial Sequence: Synthetic Antisense oligonucleotide
  misc_feature (1)..(2): bicyclic nucleic acid (BNA)
  misc_feature (20)..(20): bicyclic nucleic acid (BNA)
tcaaggaagatggcatttct

SEQ ID NO: 13549 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 13550 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (20)..(20): bicyclic nucleic acid (BNA)
tcaaggaagatggcatttct

SEQ ID NO: 13551 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (20)..(20): bicyclic nucleic acid (BNA)
tcaaggaagatggcatttct

SEQ ID NO: 13552 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 13553 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 13554 - DNA, 20 bp, Artificial Sequence
  Description of Artificial Sequence: Synthetic Antisense oligonucleotide
  misc_feature (1)..(1): bicyclic nucleic acid (BNA)
  misc_feature (19)..(20): bicyclic nucleic acid (BNA)
tcaaggaagatggcatttct

SEQ ID NO: 13555 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 13556 - DNA, 22 bp, Artificial Sequence
  Description of Artificial Sequence: Synthetic Antisense oligonucleotide
  misc_feature (1)..(2): bicyclic nucleic acid (BNA)
  misc_feature (22)..(22): bicyclic nucleic acid (BNA)
tcaaggaagatggcatttctag

SEQ ID NO: 13557 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 13558 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (22)..(22): bicyclic nucleic acid (BNA)
tcaaggaagatggcatttctag

SEQ ID NO: 13559 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (22)..(22): bicyclic nucleic acid (BNA)
tcaaggaagatggcatttctag

SEQ ID NO: 13560 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 13561 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 13562 - DNA, 22 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13563 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 13564 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 13565 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 13566 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(20): bicyclic nucleic acid (BNA)
tcaaggaagatggcatttct

SEQ ID NO: 13567 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 13568 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 13569 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 13570 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 13571 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (20)..(20): bicyclic nucleic acid (BNA)
tcaaggaagatggcatttct

SEQ ID NO: 13572 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 13573 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(20): bicyclic nucleic acid (BNA)
tcaaggaagatggcatttct

SEQ ID NO: 13574 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 13575 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (20)..(20): bicyclic nucleic acid (BNA)
tcaaggaagatggcatttct

SEQ ID NO: 13576 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 13577 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 13578 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 13579 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (20)..(20): bicyclic nucleic acid (BNA)
tcaaggaagatggcatttct

SEQ ID NO: 13580 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (20)..(20): bicyclic nucleic acid (BNA)
tcaaggaagatggcatttct

SEQ ID NO: 13581 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 13582 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (20)..(20): bicyclic nucleic acid (BNA)
tcaaggaagatggcatttct

SEQ ID NO: 13583 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 13584 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (20)..(20): bicyclic nucleic acid (BNA)
tcaaggaagatggcatttct

SEQ ID NO: 13585 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
tcaaggaagatggcatttct

SEQ ID NO: 13586 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 13587 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 13588 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
tcaaggaagatggcatttct

SEQ ID NO: 13589 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 13590 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 13591 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 13592 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 13593 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 13594 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13595 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 13596 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 13597 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 13598 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 13599 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (22)..(22): bicyclic nucleic acid (BNA)
tcaaggaagatggcatttctag

SEQ ID NO: 13600 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 13601 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13602 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 13603 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (22)..(22): bicyclic nucleic acid (BNA)
tcaaggaagatggcatttctag

SEQ ID NO: 13604 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13605 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 13606 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 13607 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (22)..(22): bicyclic nucleic acid (BNA)
tcaaggaagatggcatttctag

SEQ ID NO: 13608 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (22)..(22): bicyclic nucleic acid (BNA)
tcaaggaagatggcatttctag

SEQ ID NO: 13609 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 13610 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (22)..(22): bicyclic nucleic acid (BNA)
tcaaggaagatggcatttctag

SEQ ID NO: 13611 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13612 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (22)..(22): bicyclic nucleic acid (BNA)
tcaaggaagatggcatttctag

SEQ ID NO: 13613 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
tcaaggaagatggcatttctag

SEQ ID NO: 13614 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 13615 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 13616 - DNA, 22 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13617 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 13618 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13619 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
tcaaggaagatggcatttctag

SEQ ID NO: 13620 - DNA, 18 bp, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13621 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13622 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13623 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13624 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13625 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13626 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13627 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13628 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13629 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13630 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13631 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13632 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13633 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13634 - DNA, 18 bp, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13635 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13636 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13637 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13638 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13639 - DNA, 18 bp, Artificial Sequence
  Description of Artificial Sequence: Synthetic Antisense oligonucleotide
  misc_feature (1)..(1): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13640 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13641 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13642 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (18)..(18): bicyclic nucleic acid (BNA)
ctgtccaagcccggttga

SEQ ID NO: 13643 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13644 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13645 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
ctgtccaagcccggttga

SEQ ID NO: 13646 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13647 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
ctgtccaagcccggttga

SEQ ID NO: 13648 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (17)..(18): bicyclic nucleic acid (BNA)
ctgtccaagcccggttga

SEQ ID NO: 13649 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13650 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13651 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13652 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13653 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13654 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13655 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13656 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13657 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13658 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13659 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13660 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13661 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13662 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13663 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13664 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13665 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13666 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13667 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13668 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13669 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13670 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13671 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13672 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 13673 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13674 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (8)..(8): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13675 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13676 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13677 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13678 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13679 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13680 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13681 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13682 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13683 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13684 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13685 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13686 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13687 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13688 - DNA, 18 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (10)..(10): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13689 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13690 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13691 - DNA, 18 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (16)..(16): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13692 - DNA, 18 bp, Artificial Sequence
  Description of Artificial Sequence: Synthetic Antisense oligonucleotide
  misc_feature (1)..(1): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13693 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 13694 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13695 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13696 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13697 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13698 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13699 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13700 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13701 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13702 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13703 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13704 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13705 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13706 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13707 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13708 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13709 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13710 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13711 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13712 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13713 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13714 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (6)..(6): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13715 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13716 - DNA, 18 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13717 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13718 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13719 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (15)..(15): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13720 - DNA, 18 bp, Artificial Sequence
  Description of Artificial Sequence: Synthetic Antisense oligonucleotide
  misc_feature (1)..(1): bicyclic nucleic acid (BNA)
  misc_feature (4)..(5): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13721 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 13722 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 13723 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13724 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13725 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(12): bicyclic nucleic acid (BNA)
  misc_feature (18)..(18): bicyclic nucleic acid (BNA)
ctgtccaagcccggttga

SEQ ID NO: 13726 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13727 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13728 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13729 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(10): bicyclic nucleic acid (BNA)
  misc_feature (18)..(18): bicyclic nucleic acid (BNA)
ctgtccaagcccggttga

SEQ ID NO: 13730 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13731 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13732 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 13733 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (6)..(6): bicyclic nucleic acid (BNA)
  misc_feature (18)..(18): bicyclic nucleic acid (BNA)
ctgtccaagcccggttga

SEQ ID NO: 13734 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 13735 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13736 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (10)..(10): bicyclic nucleic acid (BNA)
  misc_feature (18)..(18): bicyclic nucleic acid (BNA)
ctgtccaagcccggttga

SEQ ID NO: 13737 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
ctgtccaagcccggttga

SEQ ID NO: 13738 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13739 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13740 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 13741 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13742 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13743 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13744 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13745 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 13746 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13747 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13748 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (17)..(18): bicyclic nucleic acid (BNA)
ctgtccaagcccggttga

SEQ ID NO: 13749 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13750 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(6): bicyclic nucleic acid (BNA)
  misc_feature (18)..(18): bicyclic nucleic acid (BNA)
ctgtccaagcccggttga

SEQ ID NO: 13751 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13752 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13753 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 13754 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13755 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(11): bicyclic nucleic acid (BNA)
  misc_feature (18)..(18): bicyclic nucleic acid (BNA)
ctgtccaagcccggttga

SEQ ID NO: 13756 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 13757 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (12)..(13): bicyclic nucleic acid (BNA)
  misc_feature (18)..(18): bicyclic nucleic acid (BNA)
ctgtccaagcccggttga

SEQ ID NO: 13758 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13759 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 13760 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ctgtccaagcccggttga

SEQ ID NO: 13761 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 13762 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13763 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 13764 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (12)..(12): bicyclic nucleic acid (BNA)
  misc_feature (18)..(18): bicyclic nucleic acid (BNA)
ctgtccaagcccggttga

SEQ ID NO: 13765 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (3)..(3): bicyclic nucleic acid (BNA)
  misc_feature (5)..(5): bicyclic nucleic acid (BNA)
  misc_feature (18)..(18): bicyclic nucleic acid (BNA)
ctgtccaagcccggttga

SEQ ID NO: 13766 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 13767 - DNA, 20 bp, Artificial Sequence
  Description of Artificial Sequence: Synthetic Antisense oligonucleotide
  misc_feature (1)..(2): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13768 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13769 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13770 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13771 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13772 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13773 - DNA, 20 bp, Artificial Sequence
  Description of Artificial Sequence: Synthetic Antisense oligonucleotide
  misc_feature (1)..(1): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13774 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13775 - DNA, 22 bp, Artificial Sequence
  Description of Artificial Sequence: Synthetic Antisense oligonucleotide
  misc_feature (1)..(2): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13776 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13777 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13778 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13779 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13780 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13781 - DNA, 22 bp, Artificial Sequence
  Description of Artificial Sequence: Synthetic Antisense oligonucleotide
  misc_feature (1)..(1): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13782 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13783 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13784 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13785 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13786 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13787 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13788 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13789 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13790 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13791 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13792 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13793 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13794 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13795 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13796 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13797 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13798 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13799 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13800 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13801 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13802 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13803 - DNA, 20 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13804 - DNA, 20 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13805 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13806 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13807 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13808 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13809 - DNA, 20 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13810 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 13811 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13812 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13813 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13814 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13815 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13816 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13817 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13818 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13819 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13820 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13821 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13822 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13823 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13824 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(12): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13825 - DNA, 22 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13826 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13827 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13828 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13829 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13830 - DNA, 22 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13831 - DNA, 22 bp, Artificial Sequence
  Description of Artificial Sequence: Synthetic Antisense oligonucleotide
  misc_feature (1)..(1): bicyclic nucleic acid (BNA)
  misc_feature (12)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13832 - DNA, 22 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (12)..(12): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13833 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13834 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13835 - DNA, 22 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13836 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13837 - DNA, 22 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13838 - DNA, 22 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (19)..(19): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 13839 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
gguaaguucuguccaagc

SEQ ID NO: 13840 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
gguaaguucuguccaagc

SEQ ID NO: 13841 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
gguaaguucuguccaagc

SEQ ID NO: 13842 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
gguaaguucuguccaagc

SEQ ID NO: 13843 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
gguaaguucuguccaagc

SEQ ID NO: 13844 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
gguaaguucuguccaagc

SEQ ID NO: 13845 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(16): bicyclic nucleic acid (BNA)
gtaaguucuguccaagcc

SEQ ID NO: 13846 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
gtaaguucuguccaagcc

SEQ ID NO: 13847 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
gtaaguucuguccaagcc

SEQ ID NO: 13848 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(17): bicyclic nucleic acid (BNA)
gtaaguucuguccaagcc

SEQ ID NO: 13849 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
gtaaguucuguccaagcc

SEQ ID NO: 13850 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
gtaaguucuguccaagcc

SEQ ID NO: 13851 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
gtaaguucuguccaagcc

SEQ ID NO: 13852 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
agucgguaaguucugucc

SEQ ID NO: 13853 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
agucgguaaguucugucc

SEQ ID NO: 13854 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
agucgguaaguucugucc

SEQ ID NO: 13855 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
agucgguaaguucugucc

SEQ ID NO: 13856 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
agucgguaaguucugucc

SEQ ID NO: 13857 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
agucgguaaguucugucc

SEQ ID NO: 13858 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
agucgguaaguucugucc

SEQ ID NO: 13859 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
ctguccaagcccgguuga

SEQ ID NO: 13860 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
ctguccaagcccgguuga

SEQ ID NO: 13861 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
ctguccaagcccgguuga

SEQ ID NO: 13862 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
ctguccaagcccgguuga

SEQ ID NO: 13863 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
ctguccaagcccgguuga

SEQ ID NO: 13864 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
ctguccaagcccgguuga

SEQ ID NO: 13865 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(17): bicyclic nucleic acid (BNA)
ctguccaagcccgguuga

SEQ ID NO: 13866 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
ctguccaagcccgguuga

SEQ ID NO: 13867 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
ctguccaagcccgguuga

SEQ ID NO: 13868 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
ctguccaagcccgguuga

SEQ ID NO: 13869 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
gguaaguucuguccaagc

SEQ ID NO: 13870 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
gguaaguucuguccaagc

SEQ ID NO: 13871 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
gguaaguucuguccaagc

SEQ ID NO: 13872 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
gguaaguucuguccaagc

SEQ ID NO: 13873 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
gguaaguucuguccaagc

SEQ ID NO: 13874 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
gguaaguucuguccaagc

SEQ ID NO: 13875 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
gguaaguucuguccaagc

SEQ ID NO: 13876 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
gguaaguucuguccaagc

SEQ ID NO: 13877 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
gguaaguucuguccaagc

SEQ ID NO: 13878 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
gguaaguucuguccaagc

SEQ ID NO: 13879 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
gguaaguucuguccaagc

SEQ ID NO: 13880 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
gguaaguucuguccaagc

SEQ ID NO: 13881 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
gguaaguucuguccaagc

SEQ ID NO: 13882 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
gguaaguucuguccaagc

SEQ ID NO: 13883 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
gguaaguucuguccaagc

SEQ ID NO: 13884 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
gtaaguucuguccaagcc

SEQ ID NO: 13885 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
gtaaguucuguccaagcc

SEQ ID NO: 13886 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
gtaaguucuguccaagcc

SEQ ID NO: 13887 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
gtaaguucuguccaagcc

SEQ ID NO: 13888 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (17)..(17): bicyclic nucleic acid (BNA)
gtaaguucuguccaagcc

SEQ ID NO: 13889 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
gtaaguucuguccaagcc

SEQ ID NO: 13890 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
gtaaguucuguccaagcc

SEQ ID NO: 13891 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
gtaaguucuguccaagcc

SEQ ID NO: 13892 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (16)..(16): bicyclic nucleic acid (BNA)
gtaaguucuguccaagcc

SEQ ID NO: 13893 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (16)..(16): bicyclic nucleic acid (BNA)
gtaaguucuguccaagcc

SEQ ID NO: 13894 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
gtaaguucuguccaagcc

SEQ ID NO: 13895 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
gtaaguucuguccaagcc

SEQ ID NO: 13896 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
gtaaguucuguccaagcc

SEQ ID NO: 13897 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
gtaaguucuguccaagcc

SEQ ID NO: 13898 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
gtaaguucuguccaagcc

SEQ ID NO: 13899 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
gtaaguucuguccaagcc

SEQ ID NO: 13900 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (16)..(16): bicyclic nucleic acid (BNA)
gtaaguucuguccaagcc

SEQ ID NO: 13901 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (16)..(16): bicyclic nucleic acid (BNA)
gtaaguucuguccaagcc

SEQ ID NO: 13902 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (16)..(16): bicyclic nucleic acid (BNA)
gtaaguucuguccaagcc

SEQ ID NO: 13903 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
gtaaguucuguccaagcc

SEQ ID NO: 13904 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
gtaaguucuguccaagcc

SEQ ID NO: 13905 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
agucgguaaguucugucc

SEQ ID NO: 13906 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
agucgguaaguucugucc

SEQ ID NO: 13907 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
agucgguaaguucugucc

SEQ ID NO: 13908 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
agucgguaaguucugucc

SEQ ID NO: 13909 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
agucgguaaguucugucc

SEQ ID NO: 13910 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
agucgguaaguucugucc

SEQ ID NO: 13911 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(17): bicyclic nucleic acid (BNA)
agucgguaaguucugucc

SEQ ID NO: 13912 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
agucgguaaguucugucc

SEQ ID NO: 13913 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
agucgguaaguucugucc

SEQ ID NO: 13914 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
agucgguaaguucugucc

SEQ ID NO: 13915 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
agucgguaaguucugucc

SEQ ID NO: 13916 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
agucgguaaguucugucc

SEQ ID NO: 13917 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
agucgguaaguucugucc

SEQ ID NO: 13918 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
agucgguaaguucugucc

SEQ ID NO: 13919 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
agucgguaaguucugucc

SEQ ID NO: 13920 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
agucgguaaguucugucc

SEQ ID NO: 13921 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(17): bicyclic nucleic acid (BNA)
agucgguaaguucugucc

SEQ ID NO: 13922 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
agucgguaaguucugucc

SEQ ID NO: 13923 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
agucgguaaguucugucc

SEQ ID NO: 13924 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
agucgguaaguucugucc

SEQ ID NO: 13925 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
agucgguaaguucugucc

SEQ ID NO: 13926 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
ctguccaagcccgguuga

SEQ ID NO: 13927 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
ctguccaagcccgguuga

SEQ ID NO: 13928 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
ctguccaagcccgguuga

SEQ ID NO: 13929 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
ctguccaagcccgguuga

SEQ ID NO: 13930 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
ctguccaagcccgguuga

SEQ ID NO: 13931 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (9)..(9): bicyclic nucleic acid (BNA)
ctguccaagcccgguuga

SEQ ID NO: 13932 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
ctguccaagcccgguuga

SEQ ID NO: 13933 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
ctguccaagcccgguuga

SEQ ID NO: 13934 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
ctguccaagcccgguuga

SEQ ID NO: 13935 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (13)..(13): bicyclic nucleic acid (BNA)
ctguccaagcccgguuga

SEQ ID NO: 13936 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
ctguccaagcccgguuga

SEQ ID NO: 13937 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (6)..(6): bicyclic nucleic acid (BNA)
ctguccaagcccgguuga

SEQ ID NO: 13938 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
ctguccaagcccgguuga

SEQ ID NO: 13939 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
ctguccaagcccgguuga

SEQ ID NO: 13940 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (10)..(10): bicyclic nucleic acid (BNA)
ctguccaagcccgguuga

SEQ ID NO: 13941 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
ctguccaagcccgguuga

SEQ ID NO: 13942 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
ctguccaagcccgguuga

SEQ ID NO: 13943 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
ctguccaagcccgguuga

SEQ ID NO: 13944 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
ctguccaagcccgguuga

SEQ ID NO: 13945 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
ctguccaagcccgguuga

SEQ ID NO: 13946 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
ctguccaagcccgguuga

SEQ ID NO: 13947 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (14)..(14): bicyclic nucleic acid (BNA)
ctguccaagcccgguuga

SEQ ID NO: 13948 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
ctguccaagcccgguuga

SEQ ID NO: 13949 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
ctguccaagcccgguuga

SEQ ID NO: 13950 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
ctguccaagcccgguuga

SEQ ID NO: 13951 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
ctguccaagcccgguuga

SEQ ID NO: 13952 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (17)..(17): bicyclic nucleic acid (BNA)
ctguccaagcccgguuga

SEQ ID NO: 13953 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
ctguccaagcccgguuga

SEQ ID NO: 13954 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
ctguccaagcccgguuga

SEQ ID NO: 13955 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
ctguccaagcccgguuga

SEQ ID NO: 13956 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
ctguccaagcccgguuga

SEQ ID NO: 13957 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
ctguccaagcccgguuga

SEQ ID NO: 13958 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (11)..(11): bicyclic nucleic acid (BNA)
ctguccaagcccgguuga

SEQ ID NO: 13959 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
ctguccaagcccgguuga

SEQ ID NO: 13960 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
ctguccaagcccgguuga

SEQ ID NO: 13961 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
ctguccaagcccgguuga

SEQ ID NO: 13962 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
ctguccaagcccgguuga

SEQ ID NO: 13963 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
ctguccaagcccgguuga

SEQ ID NO: 13964 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
ctguccaagcccgguuga

SEQ ID NO: 13965 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
ctguccaagcccgguuga

SEQ ID NO: 13966 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
ctguccaagcccgguuga

SEQ ID NO: 13967 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
ctguccaagcccgguuga

SEQ ID NO: 13968 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (12)..(12): bicyclic nucleic acid (BNA)
ctguccaagcccgguuga

SEQ ID NO: 13969 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (5)..(5): bicyclic nucleic acid (BNA)
ctguccaagcccgguuga

SEQ ID NO: 13970 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
ctguccaagcccgguuga

SEQ ID NO: 13971 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
tcaaggaagauggcauuucu

SEQ ID NO: 13972 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
tcaaggaagauggcauuucu

SEQ ID NO: 13973 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
tcaaggaagauggcauuucu

SEQ ID NO: 13974 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
tcaaggaagauggcauuucu

SEQ ID NO: 13975 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
tcaaggaagauggcauuucu

SEQ ID NO: 13976 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
tcaaggaagauggcauuucu

SEQ ID NO: 13977 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
tcaaggaagauggcauuucu

SEQ ID NO: 13978 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
tcaaggaagauggcauuucuag

SEQ ID NO: 13979 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
tcaaggaagauggcauuucuag

SEQ ID NO: 13980 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
tcaaggaagauggcauuucuag

SEQ ID NO: 13981 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
tcaaggaagauggcauuucuag

SEQ ID NO: 13982 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
tcaaggaagauggcauuucuag

SEQ ID NO: 13983 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
tcaaggaagauggcauuucuag

SEQ ID NO: 13984 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
tcaaggaagauggcauuucuag

SEQ ID NO: 13985 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
tcaaggaagauggcauuucu

SEQ ID NO: 13986 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
tcaaggaagauggcauuucu

SEQ ID NO: 13987 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
tcaaggaagauggcauuucu

SEQ ID NO: 13988 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
tcaaggaagauggcauuucu

SEQ ID NO: 13989 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
tcaaggaagauggcauuucu

SEQ ID NO: 13990 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
tcaaggaagauggcauuucu

SEQ ID NO: 13991 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
tcaaggaagauggcauuucu

SEQ ID NO: 13992 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
tcaaggaagauggcauuucu

SEQ ID NO: 13993 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
tcaaggaagauggcauuucu

SEQ ID NO: 13994 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
tcaaggaagauggcauuucu

SEQ ID NO: 13995 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
tcaaggaagauggcauuucu

SEQ ID NO: 13996 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
tcaaggaagauggcauuucu

SEQ ID NO: 13997 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
tcaaggaagauggcauuucu

SEQ ID NO: 13998 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
tcaaggaagauggcauuucu

SEQ ID NO: 13999 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
tcaaggaagauggcauuucu

SEQ ID NO: 14000 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
tcaaggaagauggcauuucu

SEQ ID NO: 14001 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
tcaaggaagauggcauuucu

SEQ ID NO: 14002 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
tcaaggaagauggcauuucu

SEQ ID NO: 14003 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
tcaaggaagauggcauuucu

SEQ ID NO: 14004 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
tcaaggaagauggcauuucu

SEQ ID NO: 14005 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
tcaaggaagauggcauuucu

SEQ ID NO: 14006 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
tcaaggaagauggcauuucuag

SEQ ID NO: 14007 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
tcaaggaagauggcauuucuag

SEQ ID NO: 14008 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
tcaaggaagauggcauuucuag

SEQ ID NO: 14009 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
tcaaggaagauggcauuucuag

SEQ ID NO: 14010 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
tcaaggaagauggcauuucuag

SEQ ID NO: 14011 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
tcaaggaagauggcauuucuag

SEQ ID NO: 14012 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
tcaaggaagauggcauuucuag

SEQ ID NO: 14013 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
tcaaggaagauggcauuucuag

SEQ ID NO: 14014 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
tcaaggaagauggcauuucuag

SEQ ID NO: 14015 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
tcaaggaagauggcauuucuag

SEQ ID NO: 14016 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
tcaaggaagauggcauuucuag

SEQ ID NO: 14017 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
tcaaggaagauggcauuucuag

SEQ ID NO: 14018 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
tcaaggaagauggcauuucuag

SEQ ID NO: 14019 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
tcaaggaagauggcauuucuag

SEQ ID NO: 14020 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
tcaaggaagauggcauuucuag

SEQ ID NO: 14021 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
tcaaggaagauggcauuucuag

SEQ ID NO: 14022 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
tcaaggaagauggcauuucuag

SEQ ID NO: 14023 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
tcaaggaagauggcauuucuag

SEQ ID NO: 14024 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
tcaaggaagauggcauuucuag

SEQ ID NO: 14025 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
tcaaggaagauggcauuucuag

SEQ ID NO: 14026 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
tcaaggaagauggcauuucuag

SEQ ID NO: 14027 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14028 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14029 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14030 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14031 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14032 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14033 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14034 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14035 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14036 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14037 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14038 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14039 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14040 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14041 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14042 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14043 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14044 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14045 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14046 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14047 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
ctguccaagcccgguuga

SEQ ID NO: 14048 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
ctguccaagcccgguuga

SEQ ID NO: 14049 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
ctguccaagcccgguuga

SEQ ID NO: 14050 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
ctguccaagcccgguuga

SEQ ID NO: 14051 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
ctguccaagcccgguuga

SEQ ID NO: 14052 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
ctguccaagcccgguuga

SEQ ID NO: 14053 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (17)..(17): bicyclic nucleic acid (BNA)
ctguccaagcccgguuga

SEQ ID NO: 14054 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
ctguccaagcccgguuga

SEQ ID NO: 14055 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(13): bicyclic nucleic acid (BNA)
ctguccaagcccgguuga

SEQ ID NO: 14056 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(14): bicyclic nucleic acid (BNA)
ctguccaagcccgguuga

SEQ ID NO: 14057 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14058 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14059 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14060 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14061 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14062 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14063 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14064 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14065 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14066 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14067 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14068 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14069 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14070 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14071 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14072 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14073 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14074 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14075 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14076 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14077 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14078 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14079 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14080 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14081 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14082 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14083 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14084 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14085 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14086 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14087 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14088 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14089 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14090 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14091 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(17): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14092 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 14093 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14094 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14095 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14096 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14097 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14098 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14099 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14100 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14101 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14102 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14103 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14104 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14105 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14106 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14107 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14108 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14109 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14110 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14111 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14112 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14113 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14114 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
ctguccaagcccgguuga

SEQ ID NO: 14115 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
ctguccaagcccgguuga

SEQ ID NO: 14116 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
ctguccaagcccgguuga

SEQ ID NO: 14117 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(12): bicyclic nucleic acid (BNA)
ctguccaagcccgguuga

SEQ ID NO: 14118 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
ctguccaagcccgguuga

SEQ ID NO: 14119 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (9)..(9): bicyclic nucleic acid (BNA)
ctguccaagcccgguuga

SEQ ID NO: 14120 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
ctguccaagcccgguuga

SEQ ID NO: 14121 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(10): bicyclic nucleic acid (BNA)
ctguccaagcccgguuga

SEQ ID NO: 14122 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
ctguccaagcccgguuga

SEQ ID NO: 14123 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (13)..(13): bicyclic nucleic acid (BNA)
ctguccaagcccgguuga

SEQ ID NO: 14124 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
ctguccaagcccgguuga

SEQ ID NO: 14125 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (6)..(6): bicyclic nucleic acid (BNA)
ctguccaagcccgguuga

SEQ ID NO: 14126 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
ctguccaagcccgguuga

SEQ ID NO: 14127 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
ctguccaagcccgguuga

SEQ ID NO: 14128 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (10)..(10): bicyclic nucleic acid (BNA)
ctguccaagcccgguuga

SEQ ID NO: 14129 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(14): bicyclic nucleic acid (BNA)
ctguccaagcccgguuga

SEQ ID NO: 14130 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
ctguccaagcccgguuga

SEQ ID NO: 14131 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
ctguccaagcccgguuga

SEQ ID NO: 14132 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
ctguccaagcccgguuga

SEQ ID NO: 14133 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
ctguccaagcccgguuga

SEQ ID NO: 14134 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
ctguccaagcccgguuga

SEQ ID NO: 14135 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (14)..(14): bicyclic nucleic acid (BNA)
ctguccaagcccgguuga

SEQ ID NO: 14136 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
ctguccaagcccgguuga

SEQ ID NO: 14137 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
ctguccaagcccgguuga

SEQ ID NO: 14138 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
ctguccaagcccgguuga

SEQ ID NO: 14139 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
ctguccaagcccgguuga

SEQ ID NO: 14140 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (17)..(17): bicyclic nucleic acid (BNA)
ctguccaagcccgguuga

SEQ ID NO: 14141 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
ctguccaagcccgguuga

SEQ ID NO: 14142 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(6): bicyclic nucleic acid (BNA)
ctguccaagcccgguuga

SEQ ID NO: 14143 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
ctguccaagcccgguuga

SEQ ID NO: 14144 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
ctguccaagcccgguuga

SEQ ID NO: 14145 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
ctguccaagcccgguuga

SEQ ID NO: 14146 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (11)..(11): bicyclic nucleic acid (BNA)
ctguccaagcccgguuga

SEQ ID NO: 14147 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(11): bicyclic nucleic acid (BNA)
ctguccaagcccgguuga

SEQ ID NO: 14148 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
ctguccaagcccgguuga

SEQ ID NO: 14149 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(13): bicyclic nucleic acid (BNA)
ctguccaagcccgguuga

SEQ ID NO: 14150 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
ctguccaagcccgguuga

SEQ ID NO: 14151 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
ctguccaagcccgguuga

SEQ ID NO: 14152 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
ctguccaagcccgguuga

SEQ ID NO: 14153 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
ctguccaagcccgguuga

SEQ ID NO: 14154 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
ctguccaagcccgguuga

SEQ ID NO: 14155 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
ctguccaagcccgguuga

SEQ ID NO: 14156 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (12)..(12): bicyclic nucleic acid (BNA)
ctguccaagcccgguuga

SEQ ID NO: 14157 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (5)..(5): bicyclic nucleic acid (BNA)
ctguccaagcccgguuga

SEQ ID NO: 14158 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
ctguccaagcccgguuga

SEQ ID NO: 14159 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14160 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14161 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14162 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14163 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14164 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14165 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14166 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14167 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14168 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14169 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14170 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14171 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14172 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14173 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14174 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14175 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14176 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14177 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14178 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14179 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14180 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14181 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14182 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14183 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14184 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14185 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14186 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14187 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14188 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14189 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14190 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14191 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14192 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14193 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 14194 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14195 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14196 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14197 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14198 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14199 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14200 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14201 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14202 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14203 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14204 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14205 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14206 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14207 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14208 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14209 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14210 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14211 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14212 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14213 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14214 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 14215 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
ggtaagttctgtccaagc

SEQ ID NO: 14216 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
ggtaagttctgtccaagc

SEQ ID NO: 14217 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
ggtaagttctgtccaagc

SEQ ID NO: 14218 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
ggtaagttctgtccaagc

SEQ ID NO: 14219 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
ggtaagttctgtccaagc

SEQ ID NO: 14220 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
ggtaagttctgtccaagc

SEQ ID NO: 14221 - DNA, 18 bp, Artificial Sequence
  Description of Artificial Sequence: Synthetic Antisense oligonucleotide
  misc_feature (1)..(2): bicyclic nucleic acid (BNA)
  misc_feature (16)..(16): bicyclic nucleic acid (BNA)
gtaagttctgtccaagcc

SEQ ID NO: 14222 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
gtaagttctgtccaagcc

SEQ ID NO: 14223 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
gtaagttctgtccaagcc

SEQ ID NO: 14224 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
gtaagttctgtccaagcc

SEQ ID NO: 14225 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
gtaagttctgtccaagcc

SEQ ID NO: 14226 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
gtaagttctgtccaagcc

SEQ ID NO: 14227 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
gtaagttctgtccaagcc

SEQ ID NO: 14228 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
agtcggtaagttctgtcc

SEQ ID NO: 14229 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
agtcggtaagttctgtcc

SEQ ID NO: 14230 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
agtcggtaagttctgtcc

SEQ ID NO: 14231 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
agtcggtaagttctgtcc

SEQ ID NO: 14232 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
agtcggtaagttctgtcc

SEQ ID NO: 14233 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
agtcggtaagttctgtcc

SEQ ID NO: 14234 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
agtcggtaagttctgtcc

SEQ ID NO: 14235 - DNA, 18 bp, Artificial Sequence
  Description of Artificial Sequence: Synthetic Antisense oligonucleotide
  misc_feature (1)..(3): bicyclic nucleic acid (BNA)
ctgtccaagcccggttga

SEQ ID NO: 14236 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
ctgtccaagcccggttga

SEQ ID NO: 14237 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
ctgtccaagcccggttga

SEQ ID NO: 14238 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
ctgtccaagcccggttga

SEQ ID NO: 14239 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
ctgtccaagcccggttga

SEQ ID NO: 14240 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
ctgtccaagcccggttga

SEQ ID NO: 14241 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
ctgtccaagcccggttga

SEQ ID NO: 14242 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
ctgtccaagcccggttga

SEQ ID NO: 14243 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
ctgtccaagcccggttga

SEQ ID NO: 14244 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
ctgtccaagcccggttga

SEQ ID NO: 14245 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
ggtaagttctgtccaagc

SEQ ID NO: 14246 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
ggtaagttctgtccaagc

SEQ ID NO: 14247 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
ggtaagttctgtccaagc

SEQ ID NO: 14248 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
ggtaagttctgtccaagc

SEQ ID NO: 14249 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ggtaagttctgtccaagc

SEQ ID NO: 14250 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
ggtaagttctgtccaagc

SEQ ID NO: 14251 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
ggtaagttctgtccaagc

SEQ ID NO: 14252 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
ggtaagttctgtccaagc

SEQ ID NO: 14253 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
ggtaagttctgtccaagc

SEQ ID NO: 14254 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
ggtaagttctgtccaagc

SEQ ID NO: 14255 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
ggtaagttctgtccaagc

SEQ ID NO: 14256 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
ggtaagttctgtccaagc

SEQ ID NO: 14257 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
ggtaagttctgtccaagc

SEQ ID NO: 14258 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
ggtaagttctgtccaagc

SEQ ID NO: 14259 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
ggtaagttctgtccaagc

SEQ ID NO: 14260 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
gtaagttctgtccaagcc

SEQ ID NO: 14261 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
gtaagttctgtccaagcc

SEQ ID NO: 14262 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
gtaagttctgtccaagcc

SEQ ID NO: 14263 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
gtaagttctgtccaagcc

SEQ ID NO: 14264 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (17)..(17): bicyclic nucleic acid (BNA)
gtaagttctgtccaagcc

SEQ ID NO: 14265 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
gtaagttctgtccaagcc

SEQ ID NO: 14266 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
gtaagttctgtccaagcc

SEQ ID NO: 14267 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
gtaagttctgtccaagcc

SEQ ID NO: 14268 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (16)..(16): bicyclic nucleic acid (BNA)
gtaagttctgtccaagcc

SEQ ID NO: 14269 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (16)..(16): bicyclic nucleic acid (BNA)
gtaagttctgtccaagcc

SEQ ID NO: 14270 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
gtaagttctgtccaagcc

SEQ ID NO: 14271 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
gtaagttctgtccaagcc

SEQ ID NO: 14272 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
gtaagttctgtccaagcc

SEQ ID NO: 14273 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
gtaagttctgtccaagcc

SEQ ID NO: 14274 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
gtaagttctgtccaagcc

SEQ ID NO: 14275 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
gtaagttctgtccaagcc

SEQ ID NO: 14276 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (16)..(16): bicyclic nucleic acid (BNA)
gtaagttctgtccaagcc

SEQ ID NO: 14277 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (16)..(16): bicyclic nucleic acid (BNA)
gtaagttctgtccaagcc

SEQ ID NO: 14278 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (16)..(16): bicyclic nucleic acid (BNA)
gtaagttctgtccaagcc

SEQ ID NO: 14279 - DNA, 18 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
gtaagttctgtccaagcc

SEQ ID NO: 14280 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
gtaagttctgtccaagcc

SEQ ID NO: 14281 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
agtcggtaagttctgtcc

SEQ ID NO: 14282 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
agtcggtaagttctgtcc

SEQ ID NO: 14283 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
agtcggtaagttctgtcc

SEQ ID NO: 14284 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
agtcggtaagttctgtcc

SEQ ID NO: 14285 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
agtcggtaagttctgtcc

SEQ ID NO: 14286 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
agtcggtaagttctgtcc

SEQ ID NO: 14287 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(17): bicyclic nucleic acid (BNA)
agtcggtaagttctgtcc

SEQ ID NO: 14288 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
agtcggtaagttctgtcc

SEQ ID NO: 14289 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
agtcggtaagttctgtcc

SEQ ID NO: 14290 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
agtcggtaagttctgtcc

SEQ ID NO: 14291 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
agtcggtaagttctgtcc

SEQ ID NO: 14292 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
agtcggtaagttctgtcc

SEQ ID NO: 14293 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
agtcggtaagttctgtcc

SEQ ID NO: 14294 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
agtcggtaagttctgtcc

SEQ ID NO: 14295 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
agtcggtaagttctgtcc

SEQ ID NO: 14296 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
agtcggtaagttctgtcc

SEQ ID NO: 14297 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(17): bicyclic nucleic acid (BNA)
agtcggtaagttctgtcc

SEQ ID NO: 14298 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
agtcggtaagttctgtcc

SEQ ID NO: 14299 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
agtcggtaagttctgtcc

SEQ ID NO: 14300 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
agtcggtaagttctgtcc

SEQ ID NO: 14301 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
agtcggtaagttctgtcc

SEQ ID NO: 14302 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
ctgtccaagcccggttga

SEQ ID NO: 14303 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
ctgtccaagcccggttga

SEQ ID NO: 14304 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
ctgtccaagcccggttga

SEQ ID NO: 14305 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
ctgtccaagcccggttga

SEQ ID NO: 14306 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
ctgtccaagcccggttga

SEQ ID NO: 14307 - DNA, 18 bp, Artificial Sequence
  Description of Artificial Sequence: Synthetic Antisense oligonucleotide
  misc_feature (1)..(3): bicyclic nucleic acid (BNA)
  misc_feature (9)..(9): bicyclic nucleic acid (BNA)
ctgtccaagcccggttga

SEQ ID NO: 14308 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
ctgtccaagcccggttga

SEQ ID NO: 14309 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
ctgtccaagcccggttga

SEQ ID NO: 14310 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
ctgtccaagcccggttga

SEQ ID NO: 14311 - DNA, 18 bp, Artificial Sequence
  Description of Artificial Sequence: Synthetic Antisense oligonucleotide
  misc_feature (1)..(3): bicyclic nucleic acid (BNA)
  misc_feature (13)..(13): bicyclic nucleic acid (BNA)
ctgtccaagcccggttga

SEQ ID NO: 14312 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
ctgtccaagcccggttga

SEQ ID NO: 14313 - DNA, 18 bp, Artificial Sequence
  Description of Artificial Sequence: Synthetic Antisense oligonucleotide
  misc_feature (1)..(3): bicyclic nucleic acid (BNA)
  misc_feature (6)..(6): bicyclic nucleic acid (BNA)
ctgtccaagcccggttga

SEQ ID NO: 14314 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
ctgtccaagcccggttga

SEQ ID NO: 14315 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
ctgtccaagcccggttga

SEQ ID NO: 14316 - DNA, 18 bp, Artificial Sequence
  Description of Artificial Sequence: Synthetic Antisense oligonucleotide
  misc_feature (1)..(3): bicyclic nucleic acid (BNA)
  misc_feature (10)..(10): bicyclic nucleic acid (BNA)
ctgtccaagcccggttga

SEQ ID NO: 14317 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
ctgtccaagcccggttga

SEQ ID NO: 14318 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
ctgtccaagcccggttga

SEQ ID NO: 14319 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
ctgtccaagcccggttga

SEQ ID NO: 14320 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
ctgtccaagcccggttga

SEQ ID NO: 14321 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
ctgtccaagcccggttga

SEQ ID NO: 14322 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
ctgtccaagcccggttga

SEQ ID NO: 14323 - DNA, 18 bp, Artificial Sequence
  Description of Artificial Sequence: Synthetic Antisense oligonucleotide
  misc_feature (1)..(3): bicyclic nucleic acid (BNA)
  misc_feature (14)..(14): bicyclic nucleic acid (BNA)
ctgtccaagcccggttga

SEQ ID NO: 14324 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
ctgtccaagcccggttga

SEQ ID NO: 14325 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
ctgtccaagcccggttga

SEQ ID NO: 14326 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
ctgtccaagcccggttga

SEQ ID NO: 14327 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
ctgtccaagcccggttga

SEQ ID NO: 14328 - DNA, 18 bp, Artificial Sequence
  Description of Artificial Sequence: Synthetic Antisense oligonucleotide
  misc_feature (1)..(3): bicyclic nucleic acid (BNA)
  misc_feature (17)..(17): bicyclic nucleic acid (BNA)
ctgtccaagcccggttga

SEQ ID NO: 14329 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
ctgtccaagcccggttga

SEQ ID NO: 14330 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
ctgtccaagcccggttga

SEQ ID NO: 14331 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
ctgtccaagcccggttga

SEQ ID NO: 14332 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
ctgtccaagcccggttga

SEQ ID NO: 14333 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
ctgtccaagcccggttga

SEQ ID NO: 14334 - DNA, 18 bp, Artificial Sequence
  Description of Artificial Sequence: Synthetic Antisense oligonucleotide
  misc_feature (1)..(3): bicyclic nucleic acid (BNA)
  misc_feature (11)..(11): bicyclic nucleic acid (BNA)
ctgtccaagcccggttga

SEQ ID NO: 14335 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
ctgtccaagcccggttga

SEQ ID NO: 14336 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
ctgtccaagcccggttga

SEQ ID NO: 14337 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
ctgtccaagcccggttga

SEQ ID NO: 14338 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
ctgtccaagcccggttga

SEQ ID NO: 14339 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
ctgtccaagcccggttga

SEQ ID NO: 14340 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
ctgtccaagcccggttga

SEQ ID NO: 14341 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
ctgtccaagcccggttga

SEQ ID NO: 14342 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
ctgtccaagcccggttga

SEQ ID NO: 14343 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
ctgtccaagcccggttga

SEQ ID NO: 14344 - DNA, 18 bp, Artificial Sequence
  Description of Artificial Sequence: Synthetic Antisense oligonucleotide
  misc_feature (1)..(3): bicyclic nucleic acid (BNA)
  misc_feature (12)..(12): bicyclic nucleic acid (BNA)
ctgtccaagcccggttga

SEQ ID NO: 14345 - DNA, 18 bp, Artificial Sequence
  Description of Artificial Sequence: Synthetic Antisense oligonucleotide
  misc_feature (1)..(3): bicyclic nucleic acid (BNA)
  misc_feature (5)..(5): bicyclic nucleic acid (BNA)
ctgtccaagcccggttga

SEQ ID NO: 14346 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
ctgtccaagcccggttga

SEQ ID NO: 14347 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
tcaaggaagatggcatttct

SEQ ID NO: 14348 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
tcaaggaagatggcatttct

SEQ ID NO: 14349 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
tcaaggaagatggcatttct

SEQ ID NO: 14350 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
tcaaggaagatggcatttct

SEQ ID NO: 14351 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
tcaaggaagatggcatttct

SEQ ID NO: 14352 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
tcaaggaagatggcatttct

SEQ ID NO: 14353 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
tcaaggaagatggcatttct

SEQ ID NO: 14354 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
tcaaggaagatggcatttctag

SEQ ID NO: 14355 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
tcaaggaagatggcatttctag

SEQ ID NO: 14356 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
tcaaggaagatggcatttctag

SEQ ID NO: 14357 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
tcaaggaagatggcatttctag

SEQ ID NO: 14358 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
tcaaggaagatggcatttctag

SEQ ID NO: 14359 - DNA, 22 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
tcaaggaagatggcatttctag

SEQ ID NO: 14360 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
tcaaggaagatggcatttctag

SEQ ID NO: 14361 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
tcaaggaagatggcatttct

SEQ ID NO: 14362 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
tcaaggaagatggcatttct

SEQ ID NO: 14363 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
tcaaggaagatggcatttct

SEQ ID NO: 14364 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
tcaaggaagatggcatttct

SEQ ID NO: 14365 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
tcaaggaagatggcatttct

SEQ ID NO: 14366 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
tcaaggaagatggcatttct

SEQ ID NO: 14367 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
tcaaggaagatggcatttct

SEQ ID NO: 14368 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
tcaaggaagatggcatttct

SEQ ID NO: 14369 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
tcaaggaagatggcatttct

SEQ ID NO: 14370 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
tcaaggaagatggcatttct

SEQ ID NO: 14371 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
tcaaggaagatggcatttct

SEQ ID NO: 14372 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
tcaaggaagatggcatttct

SEQ ID NO: 14373 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
tcaaggaagatggcatttct

SEQ ID NO: 14374 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
tcaaggaagatggcatttct

SEQ ID NO: 14375 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
tcaaggaagatggcatttct

SEQ ID NO: 14376 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
tcaaggaagatggcatttct

SEQ ID NO: 14377 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
tcaaggaagatggcatttct

SEQ ID NO: 14378 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
tcaaggaagatggcatttct

SEQ ID NO: 14379 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
tcaaggaagatggcatttct

SEQ ID NO: 14380 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
tcaaggaagatggcatttct

SEQ ID NO: 14381 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
tcaaggaagatggcatttct

SEQ ID NO: 14382 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
tcaaggaagatggcatttctag

SEQ ID NO: 14383 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
tcaaggaagatggcatttctag

SEQ ID NO: 14384 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
tcaaggaagatggcatttctag

SEQ ID NO: 14385 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
tcaaggaagatggcatttctag

SEQ ID NO: 14386 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
tcaaggaagatggcatttctag

SEQ ID NO: 14387 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
tcaaggaagatggcatttctag

SEQ ID NO: 14388 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
tcaaggaagatggcatttctag

SEQ ID NO: 14389 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
tcaaggaagatggcatttctag

SEQ ID NO: 14390 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
tcaaggaagatggcatttctag

SEQ ID NO: 14391 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
tcaaggaagatggcatttctag

SEQ ID NO: 14392 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
tcaaggaagatggcatttctag

SEQ ID NO: 14393 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
tcaaggaagatggcatttctag

SEQ ID NO: 14394 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
tcaaggaagatggcatttctag

SEQ ID NO: 14395 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
tcaaggaagatggcatttctag

SEQ ID NO: 14396 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
tcaaggaagatggcatttctag

SEQ ID NO: 14397 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
tcaaggaagatggcatttctag

SEQ ID NO: 14398 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
tcaaggaagatggcatttctag

SEQ ID NO: 14399 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
tcaaggaagatggcatttctag

SEQ ID NO: 14400 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
tcaaggaagatggcatttctag

SEQ ID NO: 14401 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
tcaaggaagatggcatttctag

SEQ ID NO: 14402 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
tcaaggaagatggcatttctag

SEQ ID NO: 14403 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14404 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14405 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14406 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14407 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14408 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14409 - DNA, 18 bp, Artificial Sequence
  Description of Artificial Sequence: Synthetic Antisense oligonucleotide
  misc_feature (1)..(2): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14410 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14411 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14412 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14413 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14414 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14415 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14416 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14417 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14418 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14419 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14420 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14421 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14422 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14423 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
ctgtccaagcccggttga

SEQ ID NO: 14424 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
ctgtccaagcccggttga

SEQ ID NO: 14425 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
ctgtccaagcccggttga

SEQ ID NO: 14426 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
ctgtccaagcccggttga

SEQ ID NO: 14427 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
ctgtccaagcccggttga

SEQ ID NO: 14428 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
ctgtccaagcccggttga

SEQ ID NO: 14429 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (17)..(17): bicyclic nucleic acid (BNA)
ctgtccaagcccggttga

SEQ ID NO: 14430 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
ctgtccaagcccggttga

SEQ ID NO: 14431 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(13): bicyclic nucleic acid (BNA)
ctgtccaagcccggttga

SEQ ID NO: 14432 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(14): bicyclic nucleic acid (BNA)
ctgtccaagcccggttga

SEQ ID NO: 14433 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14434 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14435 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14436 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14437 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14438 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14439 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14440 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14441 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14442 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14443 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14444 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14445 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14446 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14447 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 14448 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14449 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14450 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14451 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14452 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14453 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14454 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14455 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14456 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14457 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14458 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14459 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14460 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14461 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14462 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14463 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14464 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14465 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14466 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (16)..(16): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14467 - DNA, 18 bp, Artificial Sequence
  Description of Artificial Sequence: Synthetic Antisense oligonucleotide
  misc_feature (1)..(2): bicyclic nucleic acid (BNA)
  misc_feature (16)..(17): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14468 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 14469 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14470 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14471 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14472 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14473 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14474 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14475 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14476 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14477 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14478 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14479 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14480 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14481 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14482 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14483 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14484 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14485 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14486 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14487 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14488 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14489 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 14490 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (17)..(17): bicyclic nucleic acid (BNA)
ctgtccaagcccggttga

SEQ ID NO: 14491 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
ctgtccaagcccggttga

SEQ ID NO: 14492 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
ctgtccaagcccggttga

SEQ ID NO: 14493 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(12): bicyclic nucleic acid (BNA)
ctgtccaagcccggttga

SEQ ID NO: 14494 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
ctgtccaagcccggttga

SEQ ID NO: 14495 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (9)..(9): bicyclic nucleic acid (BNA)
ctgtccaagcccggttga

SEQ ID NO: 14496 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
ctgtccaagcccggttga

SEQ ID NO: 14497 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(10): bicyclic nucleic acid (BNA)
ctgtccaagcccggttga

SEQ ID NO: 14498 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
ctgtccaagcccggttga

SEQ ID NO: 14499 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (13)..(13): bicyclic nucleic acid (BNA)
ctgtccaagcccggttga

SEQ ID NO: 14500 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(13): bicyclic nucleic acid (BNA)
  misc_feature (17)..(17): bicyclic nucleic acid (BNA)
ctgtccaagcccggttga

SEQ ID NO: 14501 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (6)..(6): bicyclic nucleic acid (BNA)
ctgtccaagcccggttga

SEQ ID NO: 14502 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
ctgtccaagcccggttga

SEQ ID NO: 14503 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
ctgtccaagcccggttga

SEQ ID NO: 14504 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (10)..(10): bicyclic nucleic acid (BNA)
ctgtccaagcccggttga

SEQ ID NO: 14505 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(14): bicyclic nucleic acid (BNA)
ctgtccaagcccggttga

SEQ ID NO: 14506 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
ctgtccaagcccggttga

SEQ ID NO: 14507 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
ctgtccaagcccggttga

SEQ ID NO: 14508 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(14): bicyclic nucleic acid (BNA)
  misc_feature (17)..(17): bicyclic nucleic acid (BNA)
ctgtccaagcccggttga

SEQ ID NO: 14509 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
ctgtccaagcccggttga

SEQ ID NO: 14510 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
ctgtccaagcccggttga

SEQ ID NO: 14511 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (14)..(14): bicyclic nucleic acid (BNA)
ctgtccaagcccggttga

SEQ ID NO: 14512 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
ctgtccaagcccggttga

SEQ ID NO: 14513 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (17)..(17): bicyclic nucleic acid (BNA)
ctgtccaagcccggttga

SEQ ID NO: 14514 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
ctgtccaagcccggttga

SEQ ID NO: 14515 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
ctgtccaagcccggttga

SEQ ID NO: 14516 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (17)..(17): bicyclic nucleic acid (BNA)
ctgtccaagcccggttga

SEQ ID NO: 14517 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
ctgtccaagcccggttga

SEQ ID NO: 14518 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(6): bicyclic nucleic acid (BNA)
ctgtccaagcccggttga

SEQ ID NO: 14519 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
ctgtccaagcccggttga

SEQ ID NO: 14520 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
ctgtccaagcccggttga

SEQ ID NO: 14521 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (17)..(17): bicyclic nucleic acid (BNA)
ctgtccaagcccggttga

SEQ ID NO: 14522 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (11)..(11): bicyclic nucleic acid (BNA)
ctgtccaagcccggttga

SEQ ID NO: 14523 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(11): bicyclic nucleic acid (BNA)
ctgtccaagcccggttga

SEQ ID NO: 14524 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (17)..(17): bicyclic nucleic acid (BNA)
ctgtccaagcccggttga

SEQ ID NO: 14525 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(13): bicyclic nucleic acid (BNA)
ctgtccaagcccggttga

SEQ ID NO: 14526 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
ctgtccaagcccggttga

SEQ ID NO: 14527 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
ctgtccaagcccggttga

SEQ ID NO: 14528 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
ctgtccaagcccggttga

SEQ ID NO: 14529 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (17)..(17): bicyclic nucleic acid (BNA)
ctgtccaagcccggttga

SEQ ID NO: 14530 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
ctgtccaagcccggttga

SEQ ID NO: 14531 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (17)..(17): bicyclic nucleic acid (BNA)
ctgtccaagcccggttga

SEQ ID NO: 14532 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (12)..(12): bicyclic nucleic acid (BNA)
ctgtccaagcccggttga

SEQ ID NO: 14533 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (5)..(5): bicyclic nucleic acid (BNA)
ctgtccaagcccggttga

SEQ ID NO: 14534 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
ctgtccaagcccggttga

SEQ ID NO: 14535 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14536 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14537 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14538 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14539 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14540 - DNA, 20 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14541 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14542 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14543 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14544 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14545 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14546 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14547 - DNA, 22 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14548 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14549 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14550 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14551 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14552 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14553 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14554 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14555 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14556 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14557 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14558 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14559 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14560 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14561 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14562 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14563 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14564 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14565 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14566 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14567 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14568 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14569 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 14570 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14571 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14572 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14573 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14574 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14575 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14576 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14577 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14578 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14579 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14580 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14581 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14582 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14583 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14584 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14585 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14586 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14587 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14588 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14589 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14590 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 14591 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
gguaaguucuguccaagc

SEQ ID NO: 14592 - RNA, 18 nt, Artificial Sequence
  Description of Artificial Sequence: Synthetic Antisense oligonucleotide
  misc_feature (9)..(9): bicyclic nucleic acid (BNA)
  misc_feature (17)..(18): bicyclic nucleic acid (BNA)
gguaaguucuguccaagc

SEQ ID NO: 14593 - RNA, 18 nt, Artificial Sequence
  Description of Artificial Sequence: Synthetic Antisense oligonucleotide
  misc_feature (11)..(11): bicyclic nucleic acid (BNA)
  misc_feature (17)..(18): bicyclic nucleic acid (BNA)
gguaaguucuguccaagc

SEQ ID NO: 14594 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
gguaaguucuguccaagc

SEQ ID NO: 14595 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
gguaaguucuguccaagc

SEQ ID NO: 14596 - RNA, 18 nt, Artificial Sequence
  Description of Artificial Sequence: Synthetic Antisense oligonucleotide
  misc_feature (14)..(14): bicyclic nucleic acid (BNA)
  misc_feature (17)..(18): bicyclic nucleic acid (BNA)
gguaaguucuguccaagc

SEQ ID NO: 14597 - RNA, 18 nt, Artificial Sequence
  Description of Artificial Sequence: Synthetic Antisense oligonucleotide
  misc_feature (16)..(18): bicyclic nucleic acid (BNA)
guaaguucuguccaagcc

SEQ ID NO: 14598 - RNA, 18 nt, Artificial Sequence
  Description of Artificial Sequence: Synthetic Antisense oligonucleotide
  misc_feature (10)..(10): bicyclic nucleic acid (BNA)
  misc_feature (17)..(18): bicyclic nucleic acid (BNA)
guaaguucuguccaagcc

SEQ ID NO: 14599 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
guaaguucuguccaagcc

SEQ ID NO: 14600 - RNA, 18 nt, Artificial Sequence
  Description of Artificial Sequence: Synthetic Antisense oligonucleotide
  misc_feature (12)..(12): bicyclic nucleic acid (BNA)
  misc_feature (17)..(18): bicyclic nucleic acid (BNA)
guaaguucuguccaagcc

SEQ ID NO: 14601 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
guaaguucuguccaagcc

SEQ ID NO: 14602 - RNA, 18 nt, Artificial Sequence
  Description of Artificial Sequence: Synthetic Antisense oligonucleotide
  misc_feature (8)..(8): bicyclic nucleic acid (BNA)
  misc_feature (17)..(18): bicyclic nucleic acid (BNA)
guaaguucuguccaagcc

SEQ ID NO: 14603 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
agucgguaaguucugucc

SEQ ID NO: 14604 - RNA, 18 nt, Artificial Sequence
  Description of Artificial Sequence: Synthetic Antisense oligonucleotide
  misc_feature (4)..(4): bicyclic nucleic acid (BNA)
  misc_feature (17)..(18): bicyclic nucleic acid (BNA)
agucgguaaguucugucc

SEQ ID NO: 14605 - RNA, 18 nt, Artificial Sequence
  Description of Artificial Sequence: Synthetic Antisense oligonucleotide
  misc_feature (10)..(10): bicyclic nucleic acid (BNA)
  misc_feature (17)..(18): bicyclic nucleic acid (BNA)
agucgguaaguucugucc

SEQ ID NO: 14606 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
agucgguaaguucugucc

SEQ ID NO: 14607 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
agucgguaaguucugucc

SEQ ID NO: 14608 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
agucgguaaguucugucc

SEQ ID NO: 14609 - RNA, 18 nt, Artificial Sequence
  Description of Artificial Sequence: Synthetic Antisense oligonucleotide
  misc_feature (15)..(15): bicyclic nucleic acid (BNA)
  misc_feature (17)..(18): bicyclic nucleic acid (BNA)
agucgguaaguucugucc

SEQ ID NO: 14610 - RNA, 18 nt, Artificial Sequence
  Description of Artificial Sequence: Synthetic Antisense oligonucleotide
  misc_feature (3)..(3): bicyclic nucleic acid (BNA)
  misc_feature (17)..(18): bicyclic nucleic acid (BNA)
cuguccaagcccgguuga

SEQ ID NO: 14611 - RNA, 18 nt, Artificial Sequence
  Description of Artificial Sequence: Synthetic Antisense oligonucleotide
  misc_feature (9)..(9): bicyclic nucleic acid (BNA)
  misc_feature (17)..(18): bicyclic nucleic acid (BNA)
cuguccaagcccgguuga

SEQ ID NO: 14612 - RNA, 18 nt, Artificial Sequence
  Description of Artificial Sequence: Synthetic Antisense oligonucleotide
  misc_feature (10)..(10): bicyclic nucleic acid (BNA)
  misc_feature (17)..(18): bicyclic nucleic acid (BNA)
cuguccaagcccgguuga

SEQ ID NO: 14613 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
cuguccaagcccgguuga

SEQ ID NO: 14614 - RNA, 18 nt, Artificial Sequence
  Description of Artificial Sequence: Synthetic Antisense oligonucleotide
  misc_feature (11)..(11): bicyclic nucleic acid (BNA)
  misc_feature (17)..(18): bicyclic nucleic acid (BNA)
cuguccaagcccgguuga

SEQ ID NO: 14615 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
cuguccaagcccgguuga

SEQ ID NO: 14616 - RNA, 18 nt, Artificial Sequence
  Description of Artificial Sequence: Synthetic Antisense oligonucleotide
  misc_feature (12)..(12): bicyclic nucleic acid (BNA)
  misc_feature (17)..(18): bicyclic nucleic acid (BNA)
cuguccaagcccgguuga

SEQ ID NO: 14617 - RNA, 18 nt, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
cuguccaagcccgguuga

SEQ ID NO: 14618 - RNA, 18 nt, Artificial Sequence
  Description of Artificial Sequence: Synthetic Antisense oligonucleotide
  misc_feature (14)..(14): bicyclic nucleic acid (BNA)
  misc_feature (17)..(18): bicyclic nucleic acid (BNA)
cuguccaagcccgguuga

SEQ ID NO: 14619 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 14620 - RNA, 18 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 14621 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 14622 - RNA, 18 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 14623 - RNA, 18 nt, Artificial Sequence
  Description of Artificial Sequence: Synthetic Antisense oligonucleotide
  misc_feature (13)..(14): bicyclic nucleic acid (BNA)
  misc_feature (17)..(18): bicyclic nucleic acid (BNA)
gguaaguucuguccaagc

SEQ ID NO: 14624 - RNA, 18 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 14625 - RNA, 18 nt, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 14626 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 14627 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 14628 - RNA, 18 nt, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 14629 - RNA, 18 nt, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 14630 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
gguaaguucuguccaagc

SEQ ID NO: 14631 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (17)..(18): bicyclic nucleic acid (BNA)
gguaaguucuguccaagc

SEQ ID NO: 14632 - RNA, 18 nt, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 14633 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
gguaaguucuguccaagc

SEQ ID NO: 14634 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
guaaguucuguccaagcc

SEQ ID NO: 14635 - RNA, 18 nt, Artificial Sequence
  Description of Artificial Sequence: Synthetic Antisense oligonucleotide
  misc_feature (13)..(13): bicyclic nucleic acid (BNA)
  misc_feature (16)..(18): bicyclic nucleic acid (BNA)
guaaguucuguccaagcc

SEQ ID NO: 14636 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
guaaguucuguccaagcc

SEQ ID NO: 14637 - RNA, 18 nt, Artificial Sequence
  Description of Artificial Sequence: Synthetic Antisense oligonucleotide
  misc_feature (8)..(8): bicyclic nucleic acid (BNA)
  misc_feature (16)..(18): bicyclic nucleic acid (BNA)
guaaguucuguccaagcc

SEQ ID NO: 14638 - RNA, 18 nt, Artificial Sequence
  Description of Artificial Sequence: Synthetic Antisense oligonucleotide
  misc_feature (10)..(10): bicyclic nucleic acid (BNA)
  misc_feature (16)..(18): bicyclic nucleic acid (BNA)
guaaguucuguccaagcc

SEQ ID NO: 14639 - RNA, 18 nt, Artificial Sequence
  Description of Artificial Sequence: Synthetic Antisense oligonucleotide
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
guaaguucuguccaagcc

SEQ ID NO: 14640 - RNA, 18 nt, Artificial Sequence
  Description of Artificial Sequence: Synthetic Antisense oligonucleotide
  misc_feature (5)..(5): bicyclic nucleic acid (BNA)
  misc_feature (16)..(18): bicyclic nucleic acid (BNA)
guaaguucuguccaagcc

SEQ ID NO: 14641 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
guaaguucuguccaagcc

SEQ ID NO: 14642 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
guaaguucuguccaagcc

SEQ ID NO: 14643 - RNA, 18 nt, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
guaaguucuguccaagcc

SEQ ID NO: 14644 - RNA, 18 nt, Artificial Sequence
  Description of Artificial Sequence: Synthetic Antisense oligonucleotide
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
guaaguucuguccaagcc

SEQ ID NO: 14645 - RNA, 18 nt, Artificial Sequence
  Description of Artificial Sequence: Synthetic Antisense oligonucleotide
  misc_feature (12)..(12): bicyclic nucleic acid (BNA)
  misc_feature (16)..(18): bicyclic nucleic acid (BNA)
guaaguucuguccaagcc

SEQ ID NO: 14646 - RNA, 18 nt, Artificial Sequence
  Description of Artificial Sequence: Synthetic Antisense oligonucleotide
  misc_feature (12)..(13): bicyclic nucleic acid (BNA)
  misc_feature (17)..(18): bicyclic nucleic acid (BNA)
guaaguucuguccaagcc

SEQ ID NO: 14647 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
guaaguucuguccaagcc

SEQ ID NO: 14648 - RNA, 18 nt, Artificial Sequence
  Description of Artificial Sequence: Synthetic Antisense oligonucleotide
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
guaaguucuguccaagcc

SEQ ID NO: 14649 - RNA, 18 nt, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14650 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (17)..(18): bicyclic nucleic acid (BNA)
agucgguaaguucugucc

SEQ ID NO: 14651 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14652 - RNA, 18 nt, Artificial Sequence
  Description of Artificial Sequence: Synthetic Antisense oligonucleotide
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14653 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14654 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14655 - RNA, 18 nt, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14656 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
agucgguaaguucugucc

SEQ ID NO: 14657 - RNA, 18 nt, Artificial Sequence
  Description of Artificial Sequence: Synthetic Antisense oligonucleotide
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14658 - RNA, 18 nt, Artificial Sequence
  Description of Artificial Sequence: Synthetic Antisense oligonucleotide
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14659 - RNA, 18 nt, Artificial Sequence
  Description of Artificial Sequence: Synthetic Antisense oligonucleotide
  misc_feature (5)..(6): bicyclic nucleic acid (BNA)
  misc_feature (17)..(18): bicyclic nucleic acid (BNA)
agucgguaaguucugucc

SEQ ID NO: 14660 - RNA, 18 nt, Artificial Sequence
  Description of Artificial Sequence: Synthetic Antisense oligonucleotide
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14661 - RNA, 18 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (17)..(18): bicyclic nucleic acid (BNA)
agucgguaaguucugucc

SEQ ID NO: 14662 - RNA, 18 nt, Artificial Sequence
  Description of Artificial Sequence: Synthetic Antisense oligonucleotide
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14663 - RNA, 18 nt, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14664 - RNA, 18 nt, Artificial Sequence
  Description of Artificial Sequence: Synthetic Antisense oligonucleotide
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
agucgguaaguucugucc

SEQ ID NO: 14665 - RNA, 18 nt, Artificial Sequence
  Description of Artificial Sequence: Synthetic Antisense oligonucleotide
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14666 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14667 - RNA, 18 nt, Artificial Sequence
  Description of Artificial Sequence: Synthetic Antisense oligonucleotide
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14668 - RNA, 18 nt, Artificial Sequence
  Description of Artificial Sequence: Synthetic Antisense oligonucleotide
  misc_feature (4)..(5): bicyclic nucleic acid (BNA)
  misc_feature (17)..(18): bicyclic nucleic acid (BNA)
agucgguaaguucugucc

SEQ ID NO: 14669 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14670 - RNA, 18 nt, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 14671 - RNA, 18 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14672 - RNA, 18 nt, Artificial Sequence
  Description of Artificial Sequence: Synthetic Antisense oligonucleotide
  misc_feature (11)..(12): bicyclic nucleic acid (BNA)
  misc_feature (17)..(18): bicyclic nucleic acid (BNA)
cuguccaagcccgguuga

SEQ ID NO: 14673 - RNA, 18 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 14674 - RNA, 18 nt, Artificial Sequence
  Description of Artificial Sequence: Synthetic Antisense oligonucleotide
  misc_feature (3)..(3): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 14675 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14676 - RNA, 18 nt, Artificial Sequence
  Description of Artificial Sequence: Synthetic Antisense oligonucleotide
  misc_feature (9)..(10): bicyclic nucleic acid (BNA)
  misc_feature (17)..(18): bicyclic nucleic acid (BNA)
cuguccaagcccgguuga

SEQ ID NO: 14677 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14678 - RNA, 18 nt, Artificial Sequence
  Description of Artificial Sequence: Synthetic Antisense oligonucleotide
  misc_feature (3)..(3): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14679 - RNA, 18 nt, Artificial Sequence
  Description of Artificial Sequence: Synthetic Antisense oligonucleotide
  misc_feature (3)..(3): bicyclic nucleic acid (BNA)
  misc_feature (6)..(6): bicyclic nucleic acid (BNA)
  misc_feature (17)..(18): bicyclic nucleic acid (BNA)
cuguccaagcccgguuga

SEQ ID NO: 14680 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 14681 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 14682 - RNA, 18 nt, Artificial Sequence
  Description of Artificial Sequence: Synthetic Antisense oligonucleotide
  misc_feature (3)..(3): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 14683 - RNA, 18 nt, Artificial Sequence
  Description of Artificial Sequence: Synthetic Antisense oligonucleotide
  misc_feature (13)..(14): bicyclic nucleic acid (BNA)
  misc_feature (17)..(18): bicyclic nucleic acid (BNA)
cuguccaagcccgguuga

SEQ ID NO: 14684 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14685 - RNA, 18 nt, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14686 - RNA, 18 nt, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14687 - RNA, 18 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14688 - RNA, 18 nt, Artificial Sequence
  Description of Artificial Sequence: Synthetic Antisense oligonucleotide
  misc_feature (3)..(3): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14689 - RNA, 18 nt, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14690 - RNA, 18 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14691 - RNA, 18 nt, Artificial Sequence
  Description of Artificial Sequence: Synthetic Antisense oligonucleotide
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14692 - RNA, 18 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14693 - RNA, 18 nt, Artificial Sequence
  Description of Artificial Sequence: Synthetic Antisense oligonucleotide
  misc_feature (5)..(6): bicyclic nucleic acid (BNA)
  misc_feature (17)..(18): bicyclic nucleic acid (BNA)
cuguccaagcccgguuga

SEQ ID NO: 14694 - RNA, 18 nt, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14695 - RNA, 18 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14696 - RNA, 18 nt, Artificial Sequence
  Description of Artificial Sequence: Synthetic Antisense oligonucleotide
  misc_feature (3)..(3): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14697 - RNA, 18 nt, Artificial Sequence
  Description of Artificial Sequence: Synthetic Antisense oligonucleotide
  misc_feature (10)..(11): bicyclic nucleic acid (BNA)
  misc_feature (17)..(18): bicyclic nucleic acid (BNA)
cuguccaagcccgguuga

SEQ ID NO: 14698 - RNA, 18 nt, Artificial Sequence
  Description of Artificial Sequence: Synthetic Antisense oligonucleotide
  misc_feature (12)..(13): bicyclic nucleic acid (BNA)
  misc_feature (17)..(18): bicyclic nucleic acid (BNA)
cuguccaagcccgguuga

SEQ ID NO: 14699 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14700 - RNA, 18 nt, Artificial Sequence
  Description of Artificial Sequence: Synthetic Antisense oligonucleotide
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14701 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14702 - RNA, 18 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14703 - RNA, 18 nt, Artificial Sequence
  Description of Artificial Sequence: Synthetic Antisense oligonucleotide
  misc_feature (3)..(3): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14704 - RNA, 18 nt, Artificial Sequence
  Description of Artificial Sequence: Synthetic Antisense oligonucleotide
  misc_feature (3)..(3): bicyclic nucleic acid (BNA)
  misc_feature (5)..(5): bicyclic nucleic acid (BNA)
  misc_feature (17)..(18): bicyclic nucleic acid (BNA)
cuguccaagcccgguuga

SEQ ID NO: 14705 - RNA, 18 nt, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14706 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (19)..(20): bicyclic nucleic acid (BNA)
ucaaggaagauggcauuuct

SEQ ID NO: 14707 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (19)..(20): bicyclic nucleic acid (BNA)
ucaaggaagauggcauuuct

SEQ ID NO: 14708 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (19)..(20): bicyclic nucleic acid (BNA)
ucaaggaagauggcauuuct

SEQ ID NO: 14709 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (19)..(20): bicyclic nucleic acid (BNA)
ucaaggaagauggcauuuct

SEQ ID NO: 14710 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
  misc_feature (19)..(20): bicyclic nucleic acid (BNA)
ucaaggaagauggcauuuct

SEQ ID NO: 14711 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(13): bicyclic nucleic acid (BNA)
  misc_feature (19)..(20): bicyclic nucleic acid (BNA)
ucaaggaagauggcauuuct

SEQ ID NO: 14712 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (14)..(14): bicyclic nucleic acid (BNA)
  misc_feature (19)..(20): bicyclic nucleic acid (BNA)
ucaaggaagauggcauuuct

SEQ ID NO: 14713 - RNA, 22 nt, Artificial Sequence
  Description of Artificial Sequence: Synthetic Antisense oligonucleotide
  misc_feature (2)..(2): bicyclic nucleic acid (BNA)
  misc_feature (21)..(22): bicyclic nucleic acid (BNA)
ucaaggaagauggcauuucuag

SEQ ID NO: 14714 - RNA, 22 nt, Artificial Sequence
  Description of Artificial Sequence: Synthetic Antisense oligonucleotide
  misc_feature (9)..(9): bicyclic nucleic acid (BNA)
  misc_feature (21)..(22): bicyclic nucleic acid (BNA)
ucaaggaagauggcauuucuag

SEQ ID NO: 14715 - RNA, 22 nt, Artificial Sequence
  Description of Artificial Sequence: Synthetic Antisense oligonucleotide
  misc_feature (5)..(5): bicyclic nucleic acid (BNA)
  misc_feature (21)..(22): bicyclic nucleic acid (BNA)
ucaaggaagauggcauuucuag

SEQ ID NO: 14716 - RNA, 22 nt, Artificial Sequence
  Description of Artificial Sequence: Synthetic Antisense oligonucleotide
  misc_feature (6)..(6): bicyclic nucleic acid (BNA)
  misc_feature (21)..(22): bicyclic nucleic acid (BNA)
ucaaggaagauggcauuucuag

SEQ ID NO: 14717 - RNA, 22 nt, Artificial Sequence
  Description of Artificial Sequence: Synthetic Antisense oligonucleotide
  misc_feature (12)..(12): bicyclic nucleic acid (BNA)
  misc_feature (21)..(22): bicyclic nucleic acid (BNA)
ucaaggaagauggcauuucuag

SEQ ID NO: 14718 - RNA, 22 nt, Artificial Sequence
  Description of Artificial Sequence: Synthetic Antisense oligonucleotide
  misc_feature (13)..(13): bicyclic nucleic acid (BNA)
  misc_feature (21)..(22): bicyclic nucleic acid (BNA)
ucaaggaagauggcauuucuag

SEQ ID NO: 14719 - RNA, 22 nt, Artificial Sequence
  Description of Artificial Sequence: Synthetic Antisense oligonucleotide
  misc_feature (19)..(19): bicyclic nucleic acid (BNA)
  misc_feature (21)..(22): bicyclic nucleic acid (BNA)
ucaaggaagauggcauuucuag

SEQ ID NO: 14720 - RNA, 22 nt, Artificial Sequence
  Description of Artificial Sequence: Synthetic Antisense oligonucleotide
  misc_feature (14)..(14): bicyclic nucleic acid (BNA)
  misc_feature (21)..(22): bicyclic nucleic acid (BNA)
ucaaggaagauggcauuucuag

SEQ ID NO: 14721 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14722 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
ucaaggaagauggcauuuct

SEQ ID NO: 14723 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14724 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14725 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14726 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
ucaaggaagauggcauuuct

SEQ ID NO: 14727 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (13)..(14): bicyclic nucleic acid (BNA)
  misc_feature (19)..(20): bicyclic nucleic acid (BNA)
ucaaggaagauggcauuuct

SEQ ID NO: 14728 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14729 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14730 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (6)..(6): bicyclic nucleic acid (BNA)
  misc_feature (19)..(20): bicyclic nucleic acid (BNA)
ucaaggaagauggcauuuct

SEQ ID NO: 14731 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14732 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14733 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(6): bicyclic nucleic acid (BNA)
  misc_feature (19)..(20): bicyclic nucleic acid (BNA)
ucaaggaagauggcauuuct

SEQ ID NO: 14734 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14735 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14736 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (5)..(5): bicyclic nucleic acid (BNA)
  misc_feature (19)..(20): bicyclic nucleic acid (BNA)
ucaaggaagauggcauuuct

SEQ ID NO: 14737 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (12)..(13): bicyclic nucleic acid (BNA)
  misc_feature (19)..(20): bicyclic nucleic acid (BNA)
ucaaggaagauggcauuuct

SEQ ID NO: 14738 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14739 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14740 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14741 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): bicyclic nucleic acid (BNA)
  misc_feature (9)..(9): bicyclic nucleic acid (BNA)
  misc_feature (19)..(20): bicyclic nucleic acid (BNA)
ucaaggaagauggcauuuct

SEQ ID NO: 14742 - RNA, 22 nt, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14743 - RNA, 22 nt, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
ucaaggaagauggcauuucuag

SEQ ID NO: 14744 - RNA, 22 nt, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14745 - RNA, 22 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14746 - RNA, 22 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14747 - RNA, 22 nt, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14748 - RNA, 22 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
ucaaggaagauggcauuucuag

SEQ ID NO: 14749 - RNA, 22 nt, Artificial Sequence
  Description of Artificial Sequence: Synthetic Antisense oligonucleotide
  misc_feature (13)..(14): bicyclic nucleic acid (BNA)
  misc_feature (21)..(22): bicyclic nucleic acid (BNA)
ucaaggaagauggcauuucuag

SEQ ID NO: 14750 - RNA, 22 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14751 - RNA, 22 nt, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14752 - RNA, 22 nt, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14753 - RNA, 22 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (21)..(22): bicyclic nucleic acid (BNA)
ucaaggaagauggcauuucuag

SEQ ID NO: 14754 - RNA, 22 nt, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14755 - RNA, 22 nt, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14756 - RNA, 22 nt, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14757 - RNA, 22 nt, Artificial Sequence
  Description of Artificial Sequence: Synthetic Antisense oligonucleotide
  misc_feature (5)..(6): bicyclic nucleic acid (BNA)
  misc_feature (21)..(22): bicyclic nucleic acid (BNA)
ucaaggaagauggcauuucuag

SEQ ID NO: 14758 - RNA, 22 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14759 - RNA, 22 nt, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14760 - RNA, 22 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (21)..(22): bicyclic nucleic acid (BNA)
ucaaggaagauggcauuucuag

SEQ ID NO: 14761 - RNA, 22 nt, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14762 - RNA, 22 nt, Artificial Sequence
  Description of Artificial Sequence: Synthetic Antisense oligonucleotide
  misc_feature (12)..(13): bicyclic nucleic acid (BNA)
  misc_feature (21)..(22): bicyclic nucleic acid (BNA)
ucaaggaagauggcauuucuag

SEQ ID NO: 14763 - RNA, 22 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14764 - RNA, 22 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14765 - RNA, 22 nt, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14766 - RNA, 22 nt, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14767 - RNA, 22 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (21)..(22): bicyclic nucleic acid (BNA)
ucaaggaagauggcauuucuag

SEQ ID NO: 14768 - RNA, 22 nt, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14769 - RNA, 22 nt, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14770 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14771 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (17)..(18): bicyclic nucleic acid (BNA)
gguaaguucuguccaagc

SEQ ID NO: 14772 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (17)..(18): bicyclic nucleic acid (BNA)
gguaaguucuguccaagc

SEQ ID NO: 14773 - RNA, 18 nt, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14774 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
  misc_feature (17)..(18): bicyclic nucleic acid (BNA)
gguaaguucuguccaagc

SEQ ID NO: 14775 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
  misc_feature (17)..(18): bicyclic nucleic acid (BNA)
gguaaguucuguccaagc

SEQ ID NO: 14776 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(18): bicyclic nucleic acid (BNA)
guaaguucuguccaagcc

SEQ ID NO: 14777 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (17)..(18): bicyclic nucleic acid (BNA)
guaaguucuguccaagcc

SEQ ID NO: 14778 - RNA, 18 nt, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 14779 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (17)..(18): bicyclic nucleic acid (BNA)
guaaguucuguccaagcc

SEQ ID NO: 14780 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (17)..(18): bicyclic nucleic acid (BNA)
guaaguucuguccaagcc

SEQ ID NO: 14781 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (17)..(18): bicyclic nucleic acid (BNA)
guaaguucuguccaagcc

SEQ ID NO: 14782 - RNA, 18 nt, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14783 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (17)..(18): bicyclic nucleic acid (BNA)
agucgguaaguucugucc

SEQ ID NO: 14784 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (17)..(18): bicyclic nucleic acid (BNA)
agucgguaaguucugucc

SEQ ID NO: 14785 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (17)..(18): bicyclic nucleic acid (BNA)
agucgguaaguucugucc

SEQ ID NO: 14786 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (17)..(18): bicyclic nucleic acid (BNA)
agucgguaaguucugucc

SEQ ID NO: 14787 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (17)..(18): bicyclic nucleic acid (BNA)
agucgguaaguucugucc

SEQ ID NO: 14788 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
  misc_feature (17)..(18): bicyclic nucleic acid (BNA)
agucgguaaguucugucc

SEQ ID NO: 14789 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (17)..(18): bicyclic nucleic acid (BNA)
cuguccaagcccgguuga

SEQ ID NO: 14790 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (17)..(18): bicyclic nucleic acid (BNA)
cuguccaagcccgguuga

SEQ ID NO: 14791 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (17)..(18): bicyclic nucleic acid (BNA)
cuguccaagcccgguuga

SEQ ID NO: 14792 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (17)..(18): bicyclic nucleic acid (BNA)
cuguccaagcccgguuga

SEQ ID NO: 14793 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (17)..(18): bicyclic nucleic acid (BNA)
cuguccaagcccgguuga

SEQ ID NO: 14794 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (17)..(18): bicyclic nucleic acid (BNA)
cuguccaagcccgguuga

SEQ ID NO: 14795 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (17)..(18): bicyclic nucleic acid (BNA)
cuguccaagcccgguuga

SEQ ID NO: 14796 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
  misc_feature (17)..(18): bicyclic nucleic acid (BNA)
cuguccaagcccgguuga

SEQ ID NO: 14797 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
  misc_feature (17)..(18): bicyclic nucleic acid (BNA)
cuguccaagcccgguuga

SEQ ID NO: 14798 - RNA, 18 nt, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14799 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 14800 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14801 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 14802 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(14): bicyclic nucleic acid (BNA)
  misc_feature (17)..(18): bicyclic nucleic acid (BNA)
gguaaguucuguccaagc

SEQ ID NO: 14803 - RNA, 18 nt, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14804 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 14805 - RNA, 18 nt, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14806 - RNA, 18 nt, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14807 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 14808 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 14809 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14810 - RNA, 18 nt, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14811 - RNA, 18 nt, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14812 - RNA, 18 nt, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 14813 - RNA, 18 nt, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 14814 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (16)..(18): bicyclic nucleic acid (BNA)
guaaguucuguccaagcc

SEQ ID NO: 14815 - RNA, 18 nt, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 14816 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (16)..(18): bicyclic nucleic acid (BNA)
guaaguucuguccaagcc

SEQ ID NO: 14817 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (16)..(18): bicyclic nucleic acid (BNA)
guaaguucuguccaagcc

SEQ ID NO: 14818 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
guaaguucuguccaagcc

SEQ ID NO: 14819 - RNA, 18 nt, Artificial Sequence
  Description of Artificial Sequence: Synthetic Antisense oligonucleotide
  misc_feature (5)..(5): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 14820 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
guaaguucuguccaagcc

SEQ ID NO: 14821 - RNA, 18 nt, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 14822 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
guaaguucuguccaagcc

SEQ ID NO: 14823 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
guaaguucuguccaagcc

SEQ ID NO: 14824 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (16)..(18): bicyclic nucleic acid (BNA)
guaaguucuguccaagcc

SEQ ID NO: 14825 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(13): bicyclic nucleic acid (BNA)
  misc_feature (17)..(18): bicyclic nucleic acid (BNA)
guaaguucuguccaagcc

SEQ ID NO: 14826 - RNA, 18 nt, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 14827 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
guaaguucuguccaagcc

SEQ ID NO: 14828 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14829 - RNA, 18 nt, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14830 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14831 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14832 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14833 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14834 - RNA, 18 nt, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14835 - RNA, 18 nt, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14836 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14837 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14838 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(6): bicyclic nucleic acid (BNA)
  misc_feature (17)..(18): bicyclic nucleic acid (BNA)
agucgguaaguucugucc

SEQ ID NO: 14839 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14840 - RNA, 18 nt, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14841 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 14842 - RNA, 18 nt, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14843 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
agucgguaaguucugucc

SEQ ID NO: 14844 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14845 - RNA, 18 nt, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 14846 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 14847 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(5): bicyclic nucleic acid (BNA)
  misc_feature (17)..(18): bicyclic nucleic acid (BNA)
agucgguaaguucugucc

SEQ ID NO: 14848 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 14849 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 14850 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14851 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
  misc_feature (17)..(18): bicyclic nucleic acid (BNA)
cuguccaagcccgguuga

SEQ ID NO: 14852 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 14853 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 14854 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14855 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(10): bicyclic nucleic acid (BNA)
  misc_feature (17)..(18): bicyclic nucleic acid (BNA)
cuguccaagcccgguuga

SEQ ID NO: 14856 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14857 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14858 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (6)..(6): bicyclic nucleic acid (BNA)
  misc_feature (17)..(18): bicyclic nucleic acid (BNA)
cuguccaagcccgguuga

SEQ ID NO: 14859 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
cuguccaagcccgguuga

SEQ ID NO: 14860 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 14861 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (10)..(10): bicyclic nucleic acid (BNA)
  misc_feature (17)..(18): bicyclic nucleic acid (BNA)
cuguccaagcccgguuga

SEQ ID NO: 14862 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
  misc_feature (17)..(18): bicyclic nucleic acid (BNA)
cuguccaagcccgguuga

SEQ ID NO: 14863 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14864 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14865 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14866 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14867 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14868 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14869 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14870 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14871 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14872 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(6): bicyclic nucleic acid (BNA)
  misc_feature (17)..(18): bicyclic nucleic acid (BNA)
cuguccaagcccgguuga

SEQ ID NO: 14873 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14874 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14875 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14876 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(11): bicyclic nucleic acid (BNA)
  misc_feature (17)..(18): bicyclic nucleic acid (BNA)
cuguccaagcccgguuga

SEQ ID NO: 14877 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
  misc_feature (17)..(18): bicyclic nucleic acid (BNA)
cuguccaagcccgguuga

SEQ ID NO: 14878 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14879 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
cuguccaagcccgguuga

SEQ ID NO: 14880 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
cuguccaagcccgguuga

SEQ ID NO: 14881 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14882 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (12)..(12): bicyclic nucleic acid (BNA)
  misc_feature (17)..(18): bicyclic nucleic acid (BNA)
cuguccaagcccgguuga

SEQ ID NO: 14883 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (5)..(5): bicyclic nucleic acid (BNA)
  misc_feature (17)..(18): bicyclic nucleic acid (BNA)
cuguccaagcccgguuga

SEQ ID NO: 14884 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
cuguccaagcccgguuga

SEQ ID NO: 14885 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(20): bicyclic nucleic acid (BNA)
ucaaggaagauggcauuuct

SEQ ID NO: 14886 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(20): bicyclic nucleic acid (BNA)
ucaaggaagauggcauuuct

SEQ ID NO: 14887 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(20): bicyclic nucleic acid (BNA)
ucaaggaagauggcauuuct

SEQ ID NO: 14888 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(20): bicyclic nucleic acid (BNA)
ucaaggaagauggcauuuct

SEQ ID NO: 14889 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(20): bicyclic nucleic acid (BNA)
ucaaggaagauggcauuuct

SEQ ID NO: 14890 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(20): bicyclic nucleic acid (BNA)
ucaaggaagauggcauuuct

SEQ ID NO: 14891 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(20): bicyclic nucleic acid (BNA)
ucaaggaagauggcauuuct

SEQ ID NO: 14892 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (21)..(22): bicyclic nucleic acid (BNA)
ucaaggaagauggcauuucuag

SEQ ID NO: 14893 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (21)..(22): bicyclic nucleic acid (BNA)
ucaaggaagauggcauuucuag

SEQ ID NO: 14894 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (21)..(22): bicyclic nucleic acid (BNA)
ucaaggaagauggcauuucuag

SEQ ID NO: 14895 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (21)..(22): bicyclic nucleic acid (BNA)
ucaaggaagauggcauuucuag

SEQ ID NO: 14896 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (21)..(22): bicyclic nucleic acid (BNA)
ucaaggaagauggcauuucuag

SEQ ID NO: 14897 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (21)..(22): bicyclic nucleic acid (BNA)
ucaaggaagauggcauuucuag

SEQ ID NO: 14898 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
  misc_feature (21)..(22): bicyclic nucleic acid (BNA)
ucaaggaagauggcauuucuag

SEQ ID NO: 14899 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (21)..(22): bicyclic nucleic acid (BNA)
ucaaggaagauggcauuucuag

SEQ ID NO: 14900 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14901 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
ucaaggaagauggcauuuct

SEQ ID NO: 14902 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14903 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14904 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14905 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
ucaaggaagauggcauuuct

SEQ ID NO: 14906 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (19)..(20): bicyclic nucleic acid (BNA)
ucaaggaagauggcauuuct

SEQ ID NO: 14907 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14908 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14909 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (19)..(20): bicyclic nucleic acid (BNA)
ucaaggaagauggcauuuct

SEQ ID NO: 14910 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14911 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14912 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (19)..(20): bicyclic nucleic acid (BNA)
ucaaggaagauggcauuuct

SEQ ID NO: 14913 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (19)..(20): bicyclic nucleic acid (BNA)
ucaaggaagauggcauuuct

SEQ ID NO: 14914 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14915 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (19)..(20): bicyclic nucleic acid (BNA)
ucaaggaagauggcauuuct

SEQ ID NO: 14916 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (19)..(20): bicyclic nucleic acid (BNA)
ucaaggaagauggcauuuct

SEQ ID NO: 14917 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
ucaaggaagauggcauuuct

SEQ ID NO: 14918 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14919 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
ucaaggaagauggcauuuct

SEQ ID NO: 14920 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (19)..(20): bicyclic nucleic acid (BNA)
ucaaggaagauggcauuuct

SEQ ID NO: 14921 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14922 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
ucaaggaagauggcauuucuag

SEQ ID NO: 14923 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14924 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14925 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14926 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14927 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
ucaaggaagauggcauuucuag

SEQ ID NO: 14928 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (21)..(22): bicyclic nucleic acid (BNA)
ucaaggaagauggcauuucuag

SEQ ID NO: 14929 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14930 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14931 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14932 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (21)..(22): bicyclic nucleic acid (BNA)
ucaaggaagauggcauuucuag

SEQ ID NO: 14933 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14934 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14935 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14936 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (21)..(22): bicyclic nucleic acid (BNA)
ucaaggaagauggcauuucuag

SEQ ID NO: 14937 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (21)..(22): bicyclic nucleic acid (BNA)
ucaaggaagauggcauuucuag

SEQ ID NO: 14938 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14939 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (21)..(22): bicyclic nucleic acid (BNA)
ucaaggaagauggcauuucuag

SEQ ID NO: 14940 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14941 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (21)..(22): bicyclic nucleic acid (BNA)
ucaaggaagauggcauuucuag

SEQ ID NO: 14942 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
ucaaggaagauggcauuucuag

SEQ ID NO: 14943 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14944 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
ucaaggaagauggcauuucuag

SEQ ID NO: 14945 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14946 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (21)..(22): bicyclic nucleic acid (BNA)
ucaaggaagauggcauuucuag

SEQ ID NO: 14947 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14948 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
ucaaggaagauggcauuucuag

SEQ ID NO: 14949 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
ggtaagttctgtccaagc

SEQ ID NO: 14950 - DNA, 18 bp, Artificial Sequence
  Description of Artificial Sequence: Synthetic Antisense oligonucleotide
  misc_feature (9)..(9): bicyclic nucleic acid (BNA)
  misc_feature (17)..(18): bicyclic nucleic acid (BNA)
ggtaagttctgtccaagc

SEQ ID NO: 14951 - DNA, 18 bp, Artificial Sequence
  Description of Artificial Sequence: Synthetic Antisense oligonucleotide
  misc_feature (11)..(11): bicyclic nucleic acid (BNA)
  misc_feature (17)..(18): bicyclic nucleic acid (BNA)
ggtaagttctgtccaagc

SEQ ID NO: 14952 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
ggtaagttctgtccaagc

SEQ ID NO: 14953 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
ggtaagttctgtccaagc

SEQ ID NO: 14954 - DNA, 18 bp, Artificial Sequence
  Description of Artificial Sequence: Synthetic Antisense oligonucleotide
  misc_feature (14)..(14): bicyclic nucleic acid (BNA)
  misc_feature (17)..(18): bicyclic nucleic acid (BNA)
ggtaagttctgtccaagc

SEQ ID NO: 14955 - DNA, 18 bp, Artificial Sequence
  Description of Artificial Sequence: Synthetic Antisense oligonucleotide
  misc_feature (16)..(18): bicyclic nucleic acid (BNA)
gtaagttctgtccaagcc

SEQ ID NO: 14956 - DNA, 18 bp, Artificial Sequence
  Description of Artificial Sequence: Synthetic Antisense oligonucleotide
  misc_feature (10)..(10): bicyclic nucleic acid (BNA)
  misc_feature (17)..(18): bicyclic nucleic acid (BNA)
gtaagttctgtccaagcc

SEQ ID NO: 14957 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
gtaagttctgtccaagcc

SEQ ID NO: 14958 - DNA, 18 bp, Artificial Sequence
  Description of Artificial Sequence: Synthetic Antisense oligonucleotide
  misc_feature (12)..(12): bicyclic nucleic acid (BNA)
  misc_feature (17)..(18): bicyclic nucleic acid (BNA)
gtaagttctgtccaagcc

SEQ ID NO: 14959 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
gtaagttctgtccaagcc

SEQ ID NO: 14960 - DNA, 18 bp, Artificial Sequence
  Description of Artificial Sequence: Synthetic Antisense oligonucleotide
  misc_feature (8)..(8): bicyclic nucleic acid (BNA)
  misc_feature (17)..(18): bicyclic nucleic acid (BNA)
gtaagttctgtccaagcc

SEQ ID NO: 14961 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
agtcggtaagttctgtcc

SEQ ID NO: 14962 - DNA, 18 bp, Artificial Sequence
  Description of Artificial Sequence: Synthetic Antisense oligonucleotide
  misc_feature (4)..(4): bicyclic nucleic acid (BNA)
  misc_feature (17)..(18): bicyclic nucleic acid (BNA)
agtcggtaagttctgtcc

SEQ ID NO: 14963 - DNA, 18 bp, Artificial Sequence
  Description of Artificial Sequence: Synthetic Antisense oligonucleotide
  misc_feature (10)..(10): bicyclic nucleic acid (BNA)
  misc_feature (17)..(18): bicyclic nucleic acid (BNA)
agtcggtaagttctgtcc

SEQ ID NO: 14964 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
agtcggtaagttctgtcc

SEQ ID NO: 14965 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
agtcggtaagttctgtcc

SEQ ID NO: 14966 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
agtcggtaagttctgtcc

SEQ ID NO: 14967 - DNA, 18 bp, Artificial Sequence
  Description of Artificial Sequence: Synthetic Antisense oligonucleotide
  misc_feature (15)..(15): bicyclic nucleic acid (BNA)
  misc_feature (17)..(18): bicyclic nucleic acid (BNA)
agtcggtaagttctgtcc

SEQ ID NO: 14968 - DNA, 18 bp, Artificial Sequence
  Description of Artificial Sequence: Synthetic Antisense oligonucleotide
  misc_feature (3)..(3): bicyclic nucleic acid (BNA)
  misc_feature (17)..(18): bicyclic nucleic acid (BNA)
ctgtccaagcccggttga

SEQ ID NO: 14969 - DNA, 18 bp, Artificial Sequence
  Description of Artificial Sequence: Synthetic Antisense oligonucleotide
  misc_feature (9)..(9): bicyclic nucleic acid (BNA)
  misc_feature (17)..(18): bicyclic nucleic acid (BNA)
ctgtccaagcccggttga

SEQ ID NO: 14970 - DNA, 18 bp, Artificial Sequence
  Description of Artificial Sequence: Synthetic Antisense oligonucleotide
  misc_feature (10)..(10): bicyclic nucleic acid (BNA)
  misc_feature (17)..(18): bicyclic nucleic acid (BNA)
ctgtccaagcccggttga

SEQ ID NO: 14971 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
ctgtccaagcccggttga

SEQ ID NO: 14972 - DNA, 18 bp, Artificial Sequence
  Description of Artificial Sequence: Synthetic Antisense oligonucleotide
  misc_feature (11)..(11): bicyclic nucleic acid (BNA)
  misc_feature (17)..(18): bicyclic nucleic acid (BNA)
ctgtccaagcccggttga

SEQ ID NO: 14973 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
ctgtccaagcccggttga

SEQ ID NO: 14974 - DNA, 18 bp, Artificial Sequence
  Description of Artificial Sequence: Synthetic Antisense oligonucleotide
  misc_feature (12)..(12): bicyclic nucleic acid (BNA)
  misc_feature (17)..(18): bicyclic nucleic acid (BNA)
ctgtccaagcccggttga

SEQ ID NO: 14975 - DNA, 18 bp, Artificial Sequence
  Description of Artificial Sequence: Synthetic Antisense oligonucleotide
  misc_feature (13)..(13): bicyclic nucleic acid (BNA)
  misc_feature (17)..(18): bicyclic nucleic acid (BNA)
ctgtccaagcccggttga

SEQ ID NO: 14976 - DNA, 18 bp, Artificial Sequence
  Description of Artificial Sequence: Synthetic Antisense oligonucleotide
  misc_feature (14)..(14): bicyclic nucleic acid (BNA)
  misc_feature (17)..(18): bicyclic nucleic acid (BNA)
ctgtccaagcccggttga

SEQ ID NO: 14977 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 14978 - DNA, 18 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 14979 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 14980 - DNA, 18 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 14981 - DNA, 18 bp, Artificial Sequence
  Description of Artificial Sequence: Synthetic Antisense oligonucleotide
  misc_feature (13)..(14): bicyclic nucleic acid (BNA)
  misc_feature (17)..(18): bicyclic nucleic acid (BNA)
ggtaagttctgtccaagc

SEQ ID NO: 14982 - DNA, 18 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 14983 - DNA, 18 bp, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 14984 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 14985 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 14986 - DNA, 18 bp, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 14987 - DNA, 18 bp, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 14988 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
ggtaagttctgtccaagc

SEQ ID NO: 14989 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (17)..(18): bicyclic nucleic acid (BNA)
ggtaagttctgtccaagc

SEQ ID NO: 14990 - DNA, 18 bp, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 14991 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ggtaagttctgtccaagc

SEQ ID NO: 14992 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
gtaagttctgtccaagcc

SEQ ID NO: 14993 - DNA, 18 bp, Artificial Sequence
  Description of Artificial Sequence: Synthetic Antisense oligonucleotide
  misc_feature (13)..(13): bicyclic nucleic acid (BNA)
  misc_feature (16)..(18): bicyclic nucleic acid (BNA)
gtaagttctgtccaagcc

SEQ ID NO: 14994 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 14995 - DNA, 18 bp, Artificial Sequence
  Description of Artificial Sequence: Synthetic Antisense oligonucleotide
  misc_feature (8)..(8): bicyclic nucleic acid (BNA)
  misc_feature (16)..(18): bicyclic nucleic acid (BNA)
gtaagttctgtccaagcc

SEQ ID NO: 14996 - DNA, 18 bp, Artificial Sequence
  Description of Artificial Sequence: Synthetic Antisense oligonucleotide
  misc_feature (10)..(10): bicyclic nucleic acid (BNA)
  misc_feature (16)..(18): bicyclic nucleic acid (BNA)
gtaagttctgtccaagcc

SEQ ID NO: 14997 - DNA, 18 bp, Artificial Sequence
  Description of Artificial Sequence: Synthetic Antisense oligonucleotide
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 14998 - DNA, 18 bp, Artificial Sequence
  Description of Artificial Sequence: Synthetic Antisense oligonucleotide
  misc_feature (5)..(5): bicyclic nucleic acid (BNA)
  misc_feature (16)..(18): bicyclic nucleic acid (BNA)
gtaagttctgtccaagcc

SEQ ID NO: 14999 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15000 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15001 - DNA, 18 bp, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15002 - DNA, 18 bp, Artificial Sequence
  Description of Artificial Sequence: Synthetic Antisense oligonucleotide
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15003 - DNA, 18 bp, Artificial Sequence
  Description of Artificial Sequence: Synthetic Antisense oligonucleotide
  misc_feature (12)..(12): bicyclic nucleic acid (BNA)
  misc_feature (16)..(18): bicyclic nucleic acid (BNA)
gtaagttctgtccaagcc

SEQ ID NO: 15004 - DNA, 18 bp, Artificial Sequence
  Description of Artificial Sequence: Synthetic Antisense oligonucleotide
  misc_feature (12)..(13): bicyclic nucleic acid (BNA)
  misc_feature (17)..(18): bicyclic nucleic acid (BNA)
gtaagttctgtccaagcc

SEQ ID NO: 15005 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15006 - DNA, 18 bp, Artificial Sequence
  Description of Artificial Sequence: Synthetic Antisense oligonucleotide
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 15007 - DNA, 18 bp, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15008 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (17)..(18): bicyclic nucleic acid (BNA)
agtcggtaagttctgtcc

SEQ ID NO: 15009 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15010 - DNA, 18 bp, Artificial Sequence
  Description of Artificial Sequence: Synthetic Antisense oligonucleotide
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15011 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15012 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15013 - DNA, 18 bp, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15014 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
agtcggtaagttctgtcc

SEQ ID NO: 15015 - DNA, 18 bp, Artificial Sequence
  Description of Artificial Sequence: Synthetic Antisense oligonucleotide
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15016 - DNA, 18 bp, Artificial Sequence
  Description of Artificial Sequence: Synthetic Antisense oligonucleotide
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15017 - DNA, 18 bp, Artificial Sequence
  Description of Artificial Sequence: Synthetic Antisense oligonucleotide
  misc_feature (5)..(6): bicyclic nucleic acid (BNA)
  misc_feature (17)..(18): bicyclic nucleic acid (BNA)
agtcggtaagttctgtcc

SEQ ID NO: 15018 - DNA, 18 bp, Artificial Sequence
  Description of Artificial Sequence: Synthetic Antisense oligonucleotide
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15019 - DNA, 18 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (17)..(18): bicyclic nucleic acid (BNA)
agtcggtaagttctgtcc

SEQ ID NO: 15020 - DNA, 18 bp, Artificial Sequence
  Description of Artificial Sequence: Synthetic Antisense oligonucleotide
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15021 - DNA, 18 bp, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15022 - DNA, 18 bp, Artificial Sequence
  Description of Artificial Sequence: Synthetic Antisense oligonucleotide
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
agtcggtaagttctgtcc

SEQ ID NO: 15023 - DNA, 18 bp, Artificial Sequence
  Description of Artificial Sequence: Synthetic Antisense oligonucleotide
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15024 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15025 - DNA, 18 bp, Artificial Sequence
  Description of Artificial Sequence: Synthetic Antisense oligonucleotide
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15026 - DNA, 18 bp, Artificial Sequence
  Description of Artificial Sequence: Synthetic Antisense oligonucleotide
  misc_feature (4)..(5): bicyclic nucleic acid (BNA)
  misc_feature (17)..(18): bicyclic nucleic acid (BNA)
agtcggtaagttctgtcc

SEQ ID NO: 15027 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15028 - DNA, 18 bp, Artificial Sequence
  Description of Artificial Sequence: Synthetic Antisense oligonucleotide
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15029 - DNA, 18 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15030 - DNA, 18 bp, Artificial Sequence
  Description of Artificial Sequence: Synthetic Antisense oligonucleotide
  misc_feature (11)..(12): bicyclic nucleic acid (BNA)
  misc_feature (17)..(18): bicyclic nucleic acid (BNA)
ctgtccaagcccggttga

SEQ ID NO: 15031 - DNA, 18 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15032 - DNA, 18 bp, Artificial Sequence
  Description of Artificial Sequence: Synthetic Antisense oligonucleotide
  misc_feature (3)..(3): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15033 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15034 - DNA, 18 bp, Artificial Sequence
  Description of Artificial Sequence: Synthetic Antisense oligonucleotide
  misc_feature (9)..(10): bicyclic nucleic acid (BNA)
  misc_feature (17)..(18): bicyclic nucleic acid (BNA)
ctgtccaagcccggttga

SEQ ID NO: 15035 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15036 - DNA, 18 bp, Artificial Sequence
  Description of Artificial Sequence: Synthetic Antisense oligonucleotide
  misc_feature (3)..(3): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15037 - DNA, 18 bp, Artificial Sequence
  Description of Artificial Sequence: Synthetic Antisense oligonucleotide
  misc_feature (3)..(3): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 15038 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15039 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15040 - DNA, 18 bp, Artificial Sequence
  Description of Artificial Sequence: Synthetic Antisense oligonucleotide
  misc_feature (3)..(3): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15041 - DNA, 18 bp, Artificial Sequence
  Description of Artificial Sequence: Synthetic Antisense oligonucleotide
  misc_feature (13)..(14): bicyclic nucleic acid (BNA)
  misc_feature (17)..(18): bicyclic nucleic acid (BNA)
ctgtccaagcccggttga

SEQ ID NO: 15042 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15043 - DNA, 18 bp, Artificial Sequence
  Description of Artificial Sequence: Synthetic Antisense oligonucleotide
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15044 - DNA, 18 bp, Artificial Sequence
  Description of Artificial Sequence: Synthetic Antisense oligonucleotide
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15045 - DNA, 18 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15046 - DNA, 18 bp, Artificial Sequence
  Description of Artificial Sequence: Synthetic Antisense oligonucleotide
  misc_feature (3)..(3): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15047 - DNA, 18 bp, Artificial Sequence
  Description of Artificial Sequence: Synthetic Antisense oligonucleotide
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15048 - DNA, 18 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15049 - DNA, 18 bp, Artificial Sequence
  Description of Artificial Sequence: Synthetic Antisense oligonucleotide
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15050 - DNA, 18 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15051 - DNA, 18 bp, Artificial Sequence
  Description of Artificial Sequence: Synthetic Antisense oligonucleotide
  misc_feature (5)..(6): bicyclic nucleic acid (BNA)
  misc_feature (17)..(18): bicyclic nucleic acid (BNA)
ctgtccaagcccggttga

SEQ ID NO: 15052 - DNA, 18 bp, Artificial Sequence
  Description of Artificial Sequence: Synthetic Antisense oligonucleotide
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15053 - DNA, 18 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15054 - DNA, 18 bp, Artificial Sequence
  Description of Artificial Sequence: Synthetic Antisense oligonucleotide
  misc_feature (3)..(3): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15055 - DNA, 18 bp, Artificial Sequence
  Description of Artificial Sequence: Synthetic Antisense oligonucleotide
  misc_feature (10)..(11): bicyclic nucleic acid (BNA)
  misc_feature (17)..(18): bicyclic nucleic acid (BNA)
ctgtccaagcccggttga

SEQ ID NO: 15056 - DNA, 18 bp, Artificial Sequence
  Description of Artificial Sequence: Synthetic Antisense oligonucleotide
  misc_feature (12)..(13): bicyclic nucleic acid (BNA)
  misc_feature (17)..(18): bicyclic nucleic acid (BNA)
ctgtccaagcccggttga

SEQ ID NO: 15057 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15058 - DNA, 18 bp, Artificial Sequence
  Description of Artificial Sequence: Synthetic Antisense oligonucleotide
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15059 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15060 - DNA, 18 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15061 - DNA, 18 bp, Artificial Sequence
  Description of Artificial Sequence: Synthetic Antisense oligonucleotide
  misc_feature (3)..(3): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15062 - DNA, 18 bp, Artificial Sequence
  Description of Artificial Sequence: Synthetic Antisense oligonucleotide
  misc_feature (3)..(3): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 15063 - DNA, 18 bp, Artificial Sequence
  Description of Artificial Sequence: Synthetic Antisense oligonucleotide
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15064 - DNA, 20 bp, Artificial Sequence
  Description of Artificial Sequence: Synthetic Antisense oligonucleotide
  misc_feature (2)..(2): bicyclic nucleic acid (BNA)
  misc_feature (19)..(20): bicyclic nucleic acid (BNA)
tcaaggaagatggcatttct

SEQ ID NO: 15065 - DNA, 20 bp, Artificial Sequence
  Description of Artificial Sequence: Synthetic Antisense oligonucleotide
  misc_feature (9)..(9): bicyclic nucleic acid (BNA)
  misc_feature (19)..(20): bicyclic nucleic acid (BNA)
tcaaggaagatggcatttct

SEQ ID NO: 15066 - DNA, 20 bp, Artificial Sequence
  Description of Artificial Sequence: Synthetic Antisense oligonucleotide
  misc_feature (5)..(5): bicyclic nucleic acid (BNA)
  misc_feature (19)..(20): bicyclic nucleic acid (BNA)
tcaaggaagatggcatttct

SEQ ID NO: 15067 - DNA, 20 bp, Artificial Sequence
  Description of Artificial Sequence: Synthetic Antisense oligonucleotide
  misc_feature (6)..(6): bicyclic nucleic acid (BNA)
  misc_feature (19)..(20): bicyclic nucleic acid (BNA)
tcaaggaagatggcatttct

SEQ ID NO: 15068 - DNA, 20 bp, Artificial Sequence
  Description of Artificial Sequence: Synthetic Antisense oligonucleotide
  misc_feature (12)..(12): bicyclic nucleic acid (BNA)
  misc_feature (19)..(20): bicyclic nucleic acid (BNA)
tcaaggaagatggcatttct

SEQ ID NO: 15069 - DNA, 20 bp, Artificial Sequence
  Description of Artificial Sequence: Synthetic Antisense oligonucleotide
  misc_feature (13)..(13): bicyclic nucleic acid (BNA)
  misc_feature (19)..(20): bicyclic nucleic acid (BNA)
tcaaggaagatggcatttct

SEQ ID NO: 15070 - DNA, 20 bp, Artificial Sequence
  Description of Artificial Sequence: Synthetic Antisense oligonucleotide
  misc_feature (14)..(14): bicyclic nucleic acid (BNA)
  misc_feature (19)..(20): bicyclic nucleic acid (BNA)
tcaaggaagatggcatttct

SEQ ID NO: 15071 - DNA, 22 bp, Artificial Sequence
  Description of Artificial Sequence: Synthetic Antisense oligonucleotide
  misc_feature (2)..(2): bicyclic nucleic acid (BNA)
  misc_feature (21)..(22): bicyclic nucleic acid (BNA)
tcaaggaagatggcatttctag

SEQ ID NO: 15072 - DNA, 22 bp, Artificial Sequence
  Description of Artificial Sequence: Synthetic Antisense oligonucleotide
  misc_feature (9)..(9): bicyclic nucleic acid (BNA)
  misc_feature (21)..(22): bicyclic nucleic acid (BNA)
tcaaggaagatggcatttctag

SEQ ID NO: 15073 - DNA, 22 bp, Artificial Sequence
  Description of Artificial Sequence: Synthetic Antisense oligonucleotide
  misc_feature (5)..(5): bicyclic nucleic acid (BNA)
  misc_feature (21)..(22): bicyclic nucleic acid (BNA)
tcaaggaagatggcatttctag

SEQ ID NO: 15074 - DNA, 22 bp, Artificial Sequence
  Description of Artificial Sequence: Synthetic Antisense oligonucleotide
  misc_feature (6)..(6): bicyclic nucleic acid (BNA)
  misc_feature (21)..(22): bicyclic nucleic acid (BNA)
tcaaggaagatggcatttctag

SEQ ID NO: 15075 - DNA, 22 bp, Artificial Sequence
  Description of Artificial Sequence: Synthetic Antisense oligonucleotide
  misc_feature (12)..(12): bicyclic nucleic acid (BNA)
  misc_feature (21)..(22): bicyclic nucleic acid (BNA)
tcaaggaagatggcatttctag

SEQ ID NO: 15076 - DNA, 22 bp, Artificial Sequence
  Description of Artificial Sequence: Synthetic Antisense oligonucleotide
  misc_feature (13)..(13): bicyclic nucleic acid (BNA)
  misc_feature (21)..(22): bicyclic nucleic acid (BNA)
tcaaggaagatggcatttctag

SEQ ID NO: 15077 - DNA, 22 bp, Artificial Sequence
  Description of Artificial Sequence: Synthetic Antisense oligonucleotide
  misc_feature (19)..(19): bicyclic nucleic acid (BNA)
  misc_feature (21)..(22): bicyclic nucleic acid (BNA)
tcaaggaagatggcatttctag

SEQ ID NO: 15078 - DNA, 22 bp, Artificial Sequence
  Description of Artificial Sequence: Synthetic Antisense oligonucleotide
  misc_feature (14)..(14): bicyclic nucleic acid (BNA)
  misc_feature (21)..(22): bicyclic nucleic acid (BNA)
tcaaggaagatggcatttctag

SEQ ID NO: 15079 - DNA, 20 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15080 - DNA, 20 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15081 - DNA, 20 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15082 - DNA, 20 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15083 - DNA, 20 bp, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15084 - DNA, 20 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15085 - DNA, 20 bp, Artificial Sequence
  Description of Artificial Sequence: Synthetic Antisense oligonucleotide
  misc_feature (13)..(14): bicyclic nucleic acid (BNA)
  misc_feature (19)..(20): bicyclic nucleic acid (BNA)
tcaaggaagatggcatttct

SEQ ID NO: 15086 - DNA, 20 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15087 - DNA, 20 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15088 - DNA, 20 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (19)..(20): bicyclic nucleic acid (BNA)
tcaaggaagatggcatttct

SEQ ID NO: 15089 - DNA, 20 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15090 - DNA, 20 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15091 - DNA, 20 bp, Artificial Sequence
  Description of Artificial Sequence: Synthetic Antisense oligonucleotide
  misc_feature (5)..(6): bicyclic nucleic acid (BNA)
  misc_feature (19)..(20): bicyclic nucleic acid (BNA)
tcaaggaagatggcatttct

SEQ ID NO: 15092 - DNA, 20 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15093 - DNA, 20 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15094 - DNA, 20 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (19)..(20): bicyclic nucleic acid (BNA)
tcaaggaagatggcatttct

SEQ ID NO: 15095 - DNA, 20 bp, Artificial Sequence
  Description of Artificial Sequence: Synthetic Antisense oligonucleotide
  misc_feature (12)..(13): bicyclic nucleic acid (BNA)
  misc_feature (19)..(20): bicyclic nucleic acid (BNA)
tcaaggaagatggcatttct

SEQ ID NO: 15096 - DNA, 20 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15097 - DNA, 20 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15098 - DNA, 20 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15099 - DNA, 20 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15100 - DNA, 22 bp, Artificial Sequence
  Description of Artificial Sequence: Synthetic Antisense oligonucleotide
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15101 - DNA, 22 bp, Artificial Sequence
  Description of Artificial Sequence: Synthetic Antisense oligonucleotide
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15102 - DNA, 22 bp, Artificial Sequence
  Description of Artificial Sequence: Synthetic Antisense oligonucleotide
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15103 - DNA, 22 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15104 - DNA, 22 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15105 - DNA, 22 bp, Artificial Sequence
  Description of Artificial Sequence: Synthetic Antisense oligonucleotide
  misc_feature (2)..(2): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15106 - DNA, 22 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15107 - DNA, 22 bp, Artificial Sequence
  Description of Artificial Sequence: Synthetic Antisense oligonucleotide
  misc_feature (13)..(14): bicyclic nucleic acid (BNA)
  misc_feature (21)..(22): bicyclic nucleic acid (BNA)
tcaaggaagatggcatttctag

SEQ ID NO: 15108 - DNA, 22 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15109 - DNA, 22 bp, Artificial Sequence
  Description of Artificial Sequence: Synthetic Antisense oligonucleotide
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15110 - DNA, 22 bp, Artificial Sequence
  Description of Artificial Sequence: Synthetic Antisense oligonucleotide
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15111 - DNA, 22 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (21)..(22): bicyclic nucleic acid (BNA)
tcaaggaagatggcatttctag

SEQ ID NO: 15112 - DNA, 22 bp, Artificial Sequence
  Description of Artificial Sequence: Synthetic Antisense oligonucleotide
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15113 - DNA, 22 bp, Artificial Sequence
  Description of Artificial Sequence: Synthetic Antisense oligonucleotide
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15114 - DNA, 22 bp, Artificial Sequence
  Description of Artificial Sequence: Synthetic Antisense oligonucleotide
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15115 - DNA, 22 bp, Artificial Sequence
  Description of Artificial Sequence: Synthetic Antisense oligonucleotide
  misc_feature (5)..(6): bicyclic nucleic acid (BNA)
  misc_feature (21)..(22): bicyclic nucleic acid (BNA)
tcaaggaagatggcatttctag

SEQ ID NO: 15116 - DNA, 22 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15117 - DNA, 22 bp, Artificial Sequence
  Description of Artificial Sequence: Synthetic Antisense oligonucleotide
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15118 - DNA, 22 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (21)..(22): bicyclic nucleic acid (BNA)
tcaaggaagatggcatttctag

SEQ ID NO: 15119 - DNA, 22 bp, Artificial Sequence
  Description of Artificial Sequence: Synthetic Antisense oligonucleotide
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15120 - DNA, 22 bp, Artificial Sequence
  Description of Artificial Sequence: Synthetic Antisense oligonucleotide
  misc_feature (12)..(13): bicyclic nucleic acid (BNA)
  misc_feature (21)..(22): bicyclic nucleic acid (BNA)
tcaaggaagatggcatttctag

SEQ ID NO: 15121 - DNA, 22 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15122 - DNA, 22 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15123 - DNA, 22 bp, Artificial Sequence
  Description of Artificial Sequence: Synthetic Antisense oligonucleotide
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15124 - DNA, 22 bp, Artificial Sequence
  Description of Artificial Sequence: Synthetic Antisense oligonucleotide
  misc_feature (2)..(2): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15125 - DNA, 22 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15126 - DNA, 22 bp, Artificial Sequence
  Description of Artificial Sequence: Synthetic Antisense oligonucleotide
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15127 - DNA, 22 bp, Artificial Sequence
  Description of Artificial Sequence: Synthetic Antisense oligonucleotide
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15128 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15129 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (17)..(18): bicyclic nucleic acid (BNA)
ggtaagttctgtccaagc

SEQ ID NO: 15130 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (17)..(18): bicyclic nucleic acid (BNA)
ggtaagttctgtccaagc

SEQ ID NO: 15131 - DNA, 18 bp, Artificial Sequence
  Description of Artificial Sequence: Synthetic Antisense oligonucleotide
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15132 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(13): bicyclic nucleic acid (BNA)
  misc_feature (17)..(18): bicyclic nucleic acid (BNA)
ggtaagttctgtccaagc

SEQ ID NO: 15133 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (14)..(14): bicyclic nucleic acid (BNA)
  misc_feature (17)..(18): bicyclic nucleic acid (BNA)
ggtaagttctgtccaagc

SEQ ID NO: 15134 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (16)..(18): bicyclic nucleic acid (BNA)
gtaagttctgtccaagcc

SEQ ID NO: 15135 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (17)..(18): bicyclic nucleic acid (BNA)
gtaagttctgtccaagcc

SEQ ID NO: 15136 - DNA, 18 bp, Artificial Sequence
  Description of Artificial Sequence: Synthetic Antisense oligonucleotide
  misc_feature (5)..(5): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15137 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (17)..(18): bicyclic nucleic acid (BNA)
gtaagttctgtccaagcc

SEQ ID NO: 15138 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (17)..(18): bicyclic nucleic acid (BNA)
gtaagttctgtccaagcc

SEQ ID NO: 15139 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (17)..(18): bicyclic nucleic acid (BNA)
gtaagttctgtccaagcc

SEQ ID NO: 15140 - DNA, 18 bp, Artificial Sequence
  Description of Artificial Sequence: Synthetic Antisense oligonucleotide
  misc_feature (2)..(2): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15141 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (17)..(18): bicyclic nucleic acid (BNA)
agtcggtaagttctgtcc

SEQ ID NO: 15142 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (17)..(18): bicyclic nucleic acid (BNA)
agtcggtaagttctgtcc

SEQ ID NO: 15143 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (17)..(18): bicyclic nucleic acid (BNA)
agtcggtaagttctgtcc

SEQ ID NO: 15144 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (17)..(18): bicyclic nucleic acid (BNA)
agtcggtaagttctgtcc

SEQ ID NO: 15145 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (17)..(18): bicyclic nucleic acid (BNA)
agtcggtaagttctgtcc

SEQ ID NO: 15146 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (15)..(15): bicyclic nucleic acid (BNA)
  misc_feature (17)..(18): bicyclic nucleic acid (BNA)
agtcggtaagttctgtcc

SEQ ID NO: 15147 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (17)..(18): bicyclic nucleic acid (BNA)
ctgtccaagcccggttga

SEQ ID NO: 15148 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (17)..(18): bicyclic nucleic acid (BNA)
ctgtccaagcccggttga

SEQ ID NO: 15149 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (17)..(18): bicyclic nucleic acid (BNA)
ctgtccaagcccggttga

SEQ ID NO: 15150 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (17)..(18): bicyclic nucleic acid (BNA)
ctgtccaagcccggttga

SEQ ID NO: 15151 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (17)..(18): bicyclic nucleic acid (BNA)
ctgtccaagcccggttga

SEQ ID NO: 15152 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (17)..(18): bicyclic nucleic acid (BNA)
ctgtccaagcccggttga

SEQ ID NO: 15153 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (17)..(18): bicyclic nucleic acid (BNA)
ctgtccaagcccggttga

SEQ ID NO: 15154 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(13): bicyclic nucleic acid (BNA)
  misc_feature (17)..(18): bicyclic nucleic acid (BNA)
ctgtccaagcccggttga

SEQ ID NO: 15155 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (14)..(14): bicyclic nucleic acid (BNA)
  misc_feature (17)..(18): bicyclic nucleic acid (BNA)
ctgtccaagcccggttga

SEQ ID NO: 15156 - DNA, 18 bp, Artificial Sequence
  Description of Artificial Sequence: Synthetic Antisense oligonucleotide
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15157 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 15158 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15159 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 15160 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (13)..(14): bicyclic nucleic acid (BNA)
  misc_feature (17)..(18): bicyclic nucleic acid (BNA)
ggtaagttctgtccaagc

SEQ ID NO: 15161 - DNA, 18 bp, Artificial Sequence
  Description of Artificial Sequence: Synthetic Antisense oligonucleotide
  misc_feature (2)..(2): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15162 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 15163 - DNA, 18 bp, Artificial Sequence
  Description of Artificial Sequence: Synthetic Antisense oligonucleotide
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15164 - DNA, 18 bp, Artificial Sequence
  Description of Artificial Sequence: Synthetic Antisense oligonucleotide
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15165 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 15166 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 15167 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15168 - DNA, 18 bp, Artificial Sequence
  Description of Artificial Sequence: Synthetic Antisense oligonucleotide
  misc_feature (2)..(2): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15169 - DNA, 18 bp, Artificial Sequence
  Description of Artificial Sequence: Synthetic Antisense oligonucleotide
  misc_feature (2)..(2): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15170 - DNA, 18 bp, Artificial Sequence
  Description of Artificial Sequence: Synthetic Antisense oligonucleotide
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15171 - DNA, 18 bp, Artificial Sequence
  Description of Artificial Sequence: Synthetic Antisense oligonucleotide
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15172 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (13)..(13): bicyclic nucleic acid (BNA)
  misc_feature (16)..(18): bicyclic nucleic acid (BNA)
gtaagttctgtccaagcc

SEQ ID NO: 15173 - DNA, 18 bp, Artificial Sequence
  Description of Artificial Sequence: Synthetic Antisense oligonucleotide
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15174 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (16)..(18): bicyclic nucleic acid (BNA)
gtaagttctgtccaagcc

SEQ ID NO: 15175 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (16)..(18): bicyclic nucleic acid (BNA)
gtaagttctgtccaagcc

SEQ ID NO: 15176 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15177 - DNA, 18 bp, Artificial Sequence
  Description of Artificial Sequence: Synthetic Antisense oligonucleotide
  misc_feature (5)..(5): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15178 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15179 - DNA, 18 bp, Artificial Sequence
  Description of Artificial Sequence: Synthetic Antisense oligonucleotide
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15180 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15181 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15182 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(12): bicyclic nucleic acid (BNA)
  misc_feature (16)..(18): bicyclic nucleic acid (BNA)
gtaagttctgtccaagcc

SEQ ID NO: 15183 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (12)..(13): bicyclic nucleic acid (BNA)
  misc_feature (17)..(18): bicyclic nucleic acid (BNA)
gtaagttctgtccaagcc

SEQ ID NO: 15184 - DNA, 18 bp, Artificial Sequence
  Description of Artificial Sequence: Synthetic Antisense oligonucleotide
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15185 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 15186 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15187 - DNA, 18 bp, Artificial Sequence
  Description of Artificial Sequence: Synthetic Antisense oligonucleotide
  misc_feature (2)..(2): bicyclic nucleic acid (BNA)
  misc_feature (4)..(4): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15188 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15189 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15190 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15191 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15192 - DNA, 18 bp, Artificial Sequence
  Description of Artificial Sequence: Synthetic Antisense oligonucleotide
  misc_feature (2)..(2): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15193 - DNA, 18 bp, Artificial Sequence
  Description of Artificial Sequence: Synthetic Antisense oligonucleotide
  misc_feature (2)..(2): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15194 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15195 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15196 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(6): bicyclic nucleic acid (BNA)
  misc_feature (17)..(18): bicyclic nucleic acid (BNA)
agtcggtaagttctgtcc

SEQ ID NO: 15197 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15198 - DNA, 18 bp, Artificial Sequence
  Description of Artificial Sequence: Synthetic Antisense oligonucleotide
  misc_feature (2)..(2): bicyclic nucleic acid (BNA)
  misc_feature (5)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15199 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15200 - DNA, 18 bp, Artificial Sequence
  Description of Artificial Sequence: Synthetic Antisense oligonucleotide
  misc_feature (2)..(2): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15201 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
agtcggtaagttctgtcc

SEQ ID NO: 15202 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15203 - DNA, 18 bp, Artificial Sequence
  Description of Artificial Sequence: Synthetic Antisense oligonucleotide
  misc_feature (2)..(2): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15204 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15205 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (4)..(5): bicyclic nucleic acid (BNA)
  misc_feature (17)..(18): bicyclic nucleic acid (BNA)
agtcggtaagttctgtcc

SEQ ID NO: 15206 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15207 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15208 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15209 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(12): bicyclic nucleic acid (BNA)
  misc_feature (17)..(18): bicyclic nucleic acid (BNA)
ctgtccaagcccggttga

SEQ ID NO: 15210 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15211 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15212 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15213 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(10): bicyclic nucleic acid (BNA)
  misc_feature (17)..(18): bicyclic nucleic acid (BNA)
ctgtccaagcccggttga

SEQ ID NO: 15214 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15215 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15216 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 15217 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15218 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15219 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15220 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (13)..(14): bicyclic nucleic acid (BNA)
  misc_feature (17)..(18): bicyclic nucleic acid (BNA)
ctgtccaagcccggttga

SEQ ID NO: 15221 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15222 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15223 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15224 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15225 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15226 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15227 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15228 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15229 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15230 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(6): bicyclic nucleic acid (BNA)
  misc_feature (17)..(18): bicyclic nucleic acid (BNA)
ctgtccaagcccggttga

SEQ ID NO: 15231 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15232 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15233 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15234 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(11): bicyclic nucleic acid (BNA)
  misc_feature (17)..(18): bicyclic nucleic acid (BNA)
ctgtccaagcccggttga

SEQ ID NO: 15235 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (12)..(13): bicyclic nucleic acid (BNA)
  misc_feature (17)..(18): bicyclic nucleic acid (BNA)
ctgtccaagcccggttga

SEQ ID NO: 15236 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15237 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15238 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15239 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15240 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15241 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (3)..(3): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 15242 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15243 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(20): bicyclic nucleic acid (BNA)
tcaaggaagatggcatttct

SEQ ID NO: 15244 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(20): bicyclic nucleic acid (BNA)
tcaaggaagatggcatttct

SEQ ID NO: 15245 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(20): bicyclic nucleic acid (BNA)
tcaaggaagatggcatttct

SEQ ID NO: 15246 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(20): bicyclic nucleic acid (BNA)
tcaaggaagatggcatttct

SEQ ID NO: 15247 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(20): bicyclic nucleic acid (BNA)
tcaaggaagatggcatttct

SEQ ID NO: 15248 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(20): bicyclic nucleic acid (BNA)
tcaaggaagatggcatttct

SEQ ID NO: 15249 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(20): bicyclic nucleic acid (BNA)
tcaaggaagatggcatttct

SEQ ID NO: 15250 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (21)..(22): bicyclic nucleic acid (BNA)
tcaaggaagatggcatttctag

SEQ ID NO: 15251 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (21)..(22): bicyclic nucleic acid (BNA)
tcaaggaagatggcatttctag

SEQ ID NO: 15252 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (21)..(22): bicyclic nucleic acid (BNA)
tcaaggaagatggcatttctag

SEQ ID NO: 15253 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (21)..(22): bicyclic nucleic acid (BNA)
tcaaggaagatggcatttctag

SEQ ID NO: 15254 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (21)..(22): bicyclic nucleic acid (BNA)
tcaaggaagatggcatttctag

SEQ ID NO: 15255 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (21)..(22): bicyclic nucleic acid (BNA)
tcaaggaagatggcatttctag

SEQ ID NO: 15256 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (19)..(19): bicyclic nucleic acid (BNA)
  misc_feature (21)..(22): bicyclic nucleic acid (BNA)
tcaaggaagatggcatttctag

SEQ ID NO: 15257 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (21)..(22): bicyclic nucleic acid (BNA)
tcaaggaagatggcatttctag

SEQ ID NO: 15258 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15259 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15260 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15261 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15262 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15263 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15264 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (19)..(20): bicyclic nucleic acid (BNA)
tcaaggaagatggcatttct

SEQ ID NO: 15265 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15266 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15267 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (19)..(20): bicyclic nucleic acid (BNA)
tcaaggaagatggcatttct

SEQ ID NO: 15268 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15269 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15270 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (19)..(20): bicyclic nucleic acid (BNA)
tcaaggaagatggcatttct

SEQ ID NO: 15271 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15272 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15273 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (19)..(20): bicyclic nucleic acid (BNA)
tcaaggaagatggcatttct

SEQ ID NO: 15274 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (19)..(20): bicyclic nucleic acid (BNA)
tcaaggaagatggcatttct

SEQ ID NO: 15275 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15276 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15277 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15278 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15279 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15280 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15281 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15282 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15283 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15284 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15285 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15286 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(14): bicyclic nucleic acid (BNA)
  misc_feature (21)..(22): bicyclic nucleic acid (BNA)
tcaaggaagatggcatttctag

SEQ ID NO: 15287 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15288 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15289 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15290 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (6)..(6): bicyclic nucleic acid (BNA)
  misc_feature (21)..(22): bicyclic nucleic acid (BNA)
tcaaggaagatggcatttctag

SEQ ID NO: 15291 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15292 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15293 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15294 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(6): bicyclic nucleic acid (BNA)
  misc_feature (21)..(22): bicyclic nucleic acid (BNA)
tcaaggaagatggcatttctag

SEQ ID NO: 15295 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15296 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15297 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (5)..(5): bicyclic nucleic acid (BNA)
  misc_feature (21)..(22): bicyclic nucleic acid (BNA)
tcaaggaagatggcatttctag

SEQ ID NO: 15298 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15299 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (12)..(13): bicyclic nucleic acid (BNA)
  misc_feature (21)..(22): bicyclic nucleic acid (BNA)
tcaaggaagatggcatttctag

SEQ ID NO: 15300 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15301 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15302 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15303 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15304 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (2)..(2): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15305 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15306 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15307 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
gguaaguucuguccaagc

SEQ ID NO: 15308 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 15309 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
gguaaguucuguccaagc

SEQ ID NO: 15310 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 15311 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 15312 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(18): bicyclic nucleic acid (BNA)
gtaaguucuguccaagcc

SEQ ID NO: 15313 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
gtaaguucuguccaagcc

SEQ ID NO: 15314 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
gtaaguucuguccaagcc

SEQ ID NO: 15315 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
gtaaguucuguccaagcc

SEQ ID NO: 15316 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
gtaaguucuguccaagcc

SEQ ID NO: 15317 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (17)..(18): bicyclic nucleic acid (BNA)
gtaaguucuguccaagcc

SEQ ID NO: 15318 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(18): bicyclic nucleic acid (BNA)
agucgguaaguucugucc

SEQ ID NO: 15319 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 15320 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
agucgguaaguucugucc

SEQ ID NO: 15321 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
agucgguaaguucugucc

SEQ ID NO: 15322 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 15323 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 15324 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (17)..(18): bicyclic nucleic acid (BNA)
ctguccaagcccgguuga

SEQ ID NO: 15325 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15326 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15327 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
ctguccaagcccgguuga

SEQ ID NO: 15328 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15329 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
ctguccaagcccgguuga

SEQ ID NO: 15330 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15331 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15332 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15333 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 15334 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 15335 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
gguaaguucuguccaagc

SEQ ID NO: 15336 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
gguaaguucuguccaagc

SEQ ID NO: 15337 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 15338 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 15339 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 15340 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
gguaaguucuguccaagc

SEQ ID NO: 15341 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 15342 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
gguaaguucuguccaagc

SEQ ID NO: 15343 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
gtaaguucuguccaagcc

SEQ ID NO: 15344 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
gtaaguucuguccaagcc

SEQ ID NO: 15345 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
gtaaguucuguccaagcc

SEQ ID NO: 15346 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
gtaaguucuguccaagcc

SEQ ID NO: 15347 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
gtaaguucuguccaagcc

SEQ ID NO: 15348 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (16)..(18): bicyclic nucleic acid (BNA)
gtaaguucuguccaagcc

SEQ ID NO: 15349 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (16)..(18): bicyclic nucleic acid (BNA)
gtaaguucuguccaagcc

SEQ ID NO: 15350 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
gtaaguucuguccaagcc

SEQ ID NO: 15351 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
gtaaguucuguccaagcc

SEQ ID NO: 15352 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
gtaaguucuguccaagcc

SEQ ID NO: 15353 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
gtaaguucuguccaagcc

SEQ ID NO: 15354 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (16)..(18): bicyclic nucleic acid (BNA)
gtaaguucuguccaagcc

SEQ ID NO: 15355 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (16)..(18): bicyclic nucleic acid (BNA)
gtaaguucuguccaagcc

SEQ ID NO: 15356 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (16)..(18): bicyclic nucleic acid (BNA)
gtaaguucuguccaagcc

SEQ ID NO: 15357 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
gtaaguucuguccaagcc

SEQ ID NO: 15358 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 15359 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 15360 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 15361 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 15362 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 15363 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 15364 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 15365 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
agucgguaaguucugucc

SEQ ID NO: 15366 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 15367 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
agucgguaaguucugucc

SEQ ID NO: 15368 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
agucgguaaguucugucc

SEQ ID NO: 15369 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 15370 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
agucgguaaguucugucc

SEQ ID NO: 15371 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
  misc_feature (17)..(18): bicyclic nucleic acid (BNA)
agucgguaaguucugucc

SEQ ID NO: 15372 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
agucgguaaguucugucc

SEQ ID NO: 15373 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15374 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15375 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(12): bicyclic nucleic acid (BNA)
  misc_feature (17)..(18): bicyclic nucleic acid (BNA)
ctguccaagcccgguuga

SEQ ID NO: 15376 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15377 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15378 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15379 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(10): bicyclic nucleic acid (BNA)
  misc_feature (17)..(18): bicyclic nucleic acid (BNA)
ctguccaagcccgguuga

SEQ ID NO: 15380 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15381 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15382 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (6)..(6): bicyclic nucleic acid (BNA)
  misc_feature (17)..(18): bicyclic nucleic acid (BNA)
ctguccaagcccgguuga

SEQ ID NO: 15383 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15384 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15385 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15386 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
ctguccaagcccgguuga

SEQ ID NO: 15387 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15388 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15389 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15390 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15391 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15392 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15393 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15394 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15395 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15396 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
ctguccaagcccgguuga

SEQ ID NO: 15397 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15398 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15399 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15400 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(11): bicyclic nucleic acid (BNA)
  misc_feature (17)..(18): bicyclic nucleic acid (BNA)
ctguccaagcccgguuga

SEQ ID NO: 15401 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
ctguccaagcccgguuga

SEQ ID NO: 15402 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15403 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15404 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15405 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15406 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15407 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(3): bicyclic nucleic acid (BNA)
  misc_feature (5)..(5): bicyclic nucleic acid (BNA)
  misc_feature (17)..(18): bicyclic nucleic acid (BNA)
ctguccaagcccgguuga

SEQ ID NO: 15408 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15409 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(20): bicyclic nucleic acid (BNA)
tcaaggaagauggcauuuct

SEQ ID NO: 15410 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(20): bicyclic nucleic acid (BNA)
tcaaggaagauggcauuuct

SEQ ID NO: 15411 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(20): bicyclic nucleic acid (BNA)
tcaaggaagauggcauuuct

SEQ ID NO: 15412 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(20): bicyclic nucleic acid (BNA)
tcaaggaagauggcauuuct

SEQ ID NO: 15413 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(20): bicyclic nucleic acid (BNA)
tcaaggaagauggcauuuct

SEQ ID NO: 15414 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(20): bicyclic nucleic acid (BNA)
tcaaggaagauggcauuuct

SEQ ID NO: 15415 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (21)..(22): bicyclic nucleic acid (BNA)
tcaaggaagauggcauuucuag

SEQ ID NO: 15416 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (21)..(22): bicyclic nucleic acid (BNA)
tcaaggaagauggcauuucuag

SEQ ID NO: 15417 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (21)..(22): bicyclic nucleic acid (BNA)
tcaaggaagauggcauuucuag

SEQ ID NO: 15418 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (21)..(22): bicyclic nucleic acid (BNA)
tcaaggaagauggcauuucuag

SEQ ID NO: 15419 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (21)..(22): bicyclic nucleic acid (BNA)
tcaaggaagauggcauuucuag

SEQ ID NO: 15420 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15421 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (21)..(22): bicyclic nucleic acid (BNA)
tcaaggaagauggcauuucuag

SEQ ID NO: 15422 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
tcaaggaagauggcauuuct

SEQ ID NO: 15423 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
tcaaggaagauggcauuuct

SEQ ID NO: 15424 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
tcaaggaagauggcauuuct

SEQ ID NO: 15425 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
tcaaggaagauggcauuuct

SEQ ID NO: 15426 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
tcaaggaagauggcauuuct

SEQ ID NO: 15427 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (19)..(20): bicyclic nucleic acid (BNA)
tcaaggaagauggcauuuct

SEQ ID NO: 15428 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
tcaaggaagauggcauuuct

SEQ ID NO: 15429 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
tcaaggaagauggcauuuct

SEQ ID NO: 15430 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
tcaaggaagauggcauuuct

SEQ ID NO: 15431 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
tcaaggaagauggcauuuct

SEQ ID NO: 15432 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (19)..(20): bicyclic nucleic acid (BNA)
tcaaggaagauggcauuuct

SEQ ID NO: 15433 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
tcaaggaagauggcauuuct

SEQ ID NO: 15434 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (19)..(20): bicyclic nucleic acid (BNA)
tcaaggaagauggcauuuct

SEQ ID NO: 15435 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
tcaaggaagauggcauuuct

SEQ ID NO: 15436 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
tcaaggaagauggcauuuct

SEQ ID NO: 15437 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
tcaaggaagauggcauuucuag

SEQ ID NO: 15438 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
tcaaggaagauggcauuucuag

SEQ ID NO: 15439 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15440 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
tcaaggaagauggcauuucuag

SEQ ID NO: 15441 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
tcaaggaagauggcauuucuag

SEQ ID NO: 15442 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
tcaaggaagauggcauuucuag

SEQ ID NO: 15443 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (21)..(22): bicyclic nucleic acid (BNA)
tcaaggaagauggcauuucuag

SEQ ID NO: 15444 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
tcaaggaagauggcauuucuag

SEQ ID NO: 15445 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15446 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
tcaaggaagauggcauuucuag

SEQ ID NO: 15447 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15448 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
tcaaggaagauggcauuucuag

SEQ ID NO: 15449 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
tcaaggaagauggcauuucuag

SEQ ID NO: 15450 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (21)..(22): bicyclic nucleic acid (BNA)
tcaaggaagauggcauuucuag

SEQ ID NO: 15451 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
tcaaggaagauggcauuucuag

SEQ ID NO: 15452 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15453 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (21)..(22): bicyclic nucleic acid (BNA)
tcaaggaagauggcauuucuag

SEQ ID NO: 15454 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
tcaaggaagauggcauuucuag

SEQ ID NO: 15455 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
tcaaggaagauggcauuucuag

SEQ ID NO: 15456 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15457 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
tcaaggaagauggcauuucuag

SEQ ID NO: 15458 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15459 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15460 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15461 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15462 - RNA, 18 nt, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15463 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15464 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15465 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15466 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15467 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15468 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15469 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15470 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15471 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15472 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15473 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15474 - RNA, 18 nt, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15475 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (17)..(18): bicyclic nucleic acid (BNA)
ctguccaagcccgguuga

SEQ ID NO: 15476 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15477 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15478 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
ctguccaagcccgguuga

SEQ ID NO: 15479 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15480 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
ctguccaagcccgguuga

SEQ ID NO: 15481 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15482 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15483 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15484 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15485 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15486 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15487 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15488 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15489 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15490 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15491 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15492 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15493 - RNA, 18 nt, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15494 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15495 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15496 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15497 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15498 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15499 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15500 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15501 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15502 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15503 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15504 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15505 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15506 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15507 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15508 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaaguucuguccaagcc

SEQ ID NO: 15509 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15510 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15511 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15512 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15513 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15514 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15515 - RNA, 18 nt, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15516 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15517 - RNA, 18 nt, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15518 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15519 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15520 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15521 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15522 - RNA, 18 nt, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15523 - RNA, 18 nt, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15524 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15525 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15526 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(12): bicyclic nucleic acid (BNA)
  misc_feature (17)..(18): bicyclic nucleic acid (BNA)
ctguccaagcccgguuga

SEQ ID NO: 15527 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15528 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15529 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15530 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(10): bicyclic nucleic acid (BNA)
  misc_feature (17)..(18): bicyclic nucleic acid (BNA)
ctguccaagcccgguuga

SEQ ID NO: 15531 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15532 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15533 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (6)..(6): bicyclic nucleic acid (BNA)
  misc_feature (17)..(18): bicyclic nucleic acid (BNA)
ctguccaagcccgguuga

SEQ ID NO: 15534 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ctguccaagcccgguuga

SEQ ID NO: 15535 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15536 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (10)..(10): bicyclic nucleic acid (BNA)
  misc_feature (17)..(18): bicyclic nucleic acid (BNA)
ctguccaagcccgguuga

SEQ ID NO: 15537 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
ctguccaagcccgguuga

SEQ ID NO: 15538 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15539 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15540 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15541 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15542 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15543 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15544 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15545 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15546 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15547 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
ctguccaagcccgguuga

SEQ ID NO: 15548 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15549 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15550 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15551 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(11): bicyclic nucleic acid (BNA)
  misc_feature (17)..(18): bicyclic nucleic acid (BNA)
ctguccaagcccgguuga

SEQ ID NO: 15552 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
ctguccaagcccgguuga

SEQ ID NO: 15553 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15554 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
ctguccaagcccgguuga

SEQ ID NO: 15555 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ctguccaagcccgguuga

SEQ ID NO: 15556 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15557 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (12)..(12): bicyclic nucleic acid (BNA)
  misc_feature (17)..(18): bicyclic nucleic acid (BNA)
ctguccaagcccgguuga

SEQ ID NO: 15558 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (5)..(5): bicyclic nucleic acid (BNA)
  misc_feature (17)..(18): bicyclic nucleic acid (BNA)
ctguccaagcccgguuga

SEQ ID NO: 15559 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
ctguccaagcccgguuga

SEQ ID NO: 15560 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15561 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15562 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15563 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15564 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15565 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15566 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15567 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15568 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15569 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15570 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15571 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15572 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15573 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15574 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15575 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15576 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15577 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15578 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15579 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15580 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15581 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15582 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15583 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15584 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15585 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15586 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15587 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 15588 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15589 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15590 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15591 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15592 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15593 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15594 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15595 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15596 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15597 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15598 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15599 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15600 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15601 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(6): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15602 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15603 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15604 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (12)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15605 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15606 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15607 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15608 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 15609 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
ggtaagttctgtccaagc

SEQ ID NO: 15610 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 15611 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
ggtaagttctgtccaagc

SEQ ID NO: 15612 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 15613 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 15614 - DNA, 18 bp, Artificial Sequence
  Description of Artificial Sequence: Synthetic Antisense oligonucleotide
  misc_feature (1)..(2): bicyclic nucleic acid (BNA)
  misc_feature (16)..(18): bicyclic nucleic acid (BNA)
gtaagttctgtccaagcc

SEQ ID NO: 15615 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 15616 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
gtaagttctgtccaagcc

SEQ ID NO: 15617 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15618 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15619 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (17)..(18): bicyclic nucleic acid (BNA)
gtaagttctgtccaagcc

SEQ ID NO: 15620 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(18): bicyclic nucleic acid (BNA)
agtcggtaagttctgtcc

SEQ ID NO: 15621 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15622 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
agtcggtaagttctgtcc

SEQ ID NO: 15623 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
agtcggtaagttctgtcc

SEQ ID NO: 15624 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15625 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15626 - DNA, 18 bp, Artificial Sequence
  Description of Artificial Sequence: Synthetic Antisense oligonucleotide
  misc_feature (1)..(3): bicyclic nucleic acid (BNA)
  misc_feature (17)..(18): bicyclic nucleic acid (BNA)
ctgtccaagcccggttga

SEQ ID NO: 15627 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15628 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15629 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 15630 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15631 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 15632 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15633 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15634 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15635 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 15636 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 15637 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ggtaagttctgtccaagc

SEQ ID NO: 15638 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
ggtaagttctgtccaagc

SEQ ID NO: 15639 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 15640 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 15641 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 15642 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ggtaagttctgtccaagc

SEQ ID NO: 15643 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 15644 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ggtaagttctgtccaagc

SEQ ID NO: 15645 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
gtaagttctgtccaagcc

SEQ ID NO: 15646 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15647 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15648 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15649 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 15650 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (16)..(18): bicyclic nucleic acid (BNA)
gtaagttctgtccaagcc

SEQ ID NO: 15651 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (16)..(18): bicyclic nucleic acid (BNA)
gtaagttctgtccaagcc

SEQ ID NO: 15652 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15653 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
gtaagttctgtccaagcc

SEQ ID NO: 15654 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
gtaagttctgtccaagcc

SEQ ID NO: 15655 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
gtaagttctgtccaagcc

SEQ ID NO: 15656 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (16)..(18): bicyclic nucleic acid (BNA)
gtaagttctgtccaagcc

SEQ ID NO: 15657 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (16)..(18): bicyclic nucleic acid (BNA)
gtaagttctgtccaagcc

SEQ ID NO: 15658 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (16)..(18): bicyclic nucleic acid (BNA)
gtaagttctgtccaagcc

SEQ ID NO: 15659 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
gtaagttctgtccaagcc

SEQ ID NO: 15660 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15661 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15662 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15663 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15664 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15665 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15666 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15667 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
agtcggtaagttctgtcc

SEQ ID NO: 15668 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15669 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
agtcggtaagttctgtcc

SEQ ID NO: 15670 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
agtcggtaagttctgtcc

SEQ ID NO: 15671 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15672 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
agtcggtaagttctgtcc

SEQ ID NO: 15673 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
  misc_feature (17)..(18): bicyclic nucleic acid (BNA)
agtcggtaagttctgtcc

SEQ ID NO: 15674 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
agtcggtaagttctgtcc

SEQ ID NO: 15675 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15676 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15677 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(12): bicyclic nucleic acid (BNA)
  misc_feature (17)..(18): bicyclic nucleic acid (BNA)
ctgtccaagcccggttga

SEQ ID NO: 15678 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15679 - DNA, 18 bp, Artificial Sequence
  Description of Artificial Sequence: Synthetic Antisense oligonucleotide
  misc_feature (1)..(3): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15680 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15681 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(10): bicyclic nucleic acid (BNA)
  misc_feature (17)..(18): bicyclic nucleic acid (BNA)
ctgtccaagcccggttga

SEQ ID NO: 15682 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15683 - DNA, 18 bp, Artificial Sequence
  Description of Artificial Sequence: Synthetic Antisense oligonucleotide
  misc_feature (1)..(3): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15684 - DNA, 18 bp, Artificial Sequence
  Description of Artificial Sequence: Synthetic Antisense oligonucleotide
  misc_feature (1)..(3): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 15685 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15686 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15687 - DNA, 18 bp, Artificial Sequence
  Description of Artificial Sequence: Synthetic Antisense oligonucleotide
  misc_feature (1)..(3): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15688 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
ctgtccaagcccggttga

SEQ ID NO: 15689 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15690 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15691 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15692 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15693 - DNA, 18 bp, Artificial Sequence
  Description of Artificial Sequence: Synthetic Antisense oligonucleotide
  misc_feature (1)..(3): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15694 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15695 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15696 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15697 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15698 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
ctgtccaagcccggttga

SEQ ID NO: 15699 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15700 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15701 - DNA, 18 bp, Artificial Sequence
  Description of Artificial Sequence: Synthetic Antisense oligonucleotide
  misc_feature (1)..(3): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15702 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(11): bicyclic nucleic acid (BNA)
  misc_feature (17)..(18): bicyclic nucleic acid (BNA)
ctgtccaagcccggttga

SEQ ID NO: 15703 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
ctgtccaagcccggttga

SEQ ID NO: 15704 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15705 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15706 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15707 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15708 - DNA, 18 bp, Artificial Sequence
  Description of Artificial Sequence: Synthetic Antisense oligonucleotide
  misc_feature (1)..(3): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15709 - DNA, 18 bp, Artificial Sequence
  Description of Artificial Sequence: Synthetic Antisense oligonucleotide
  misc_feature (1)..(3): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 15710 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15711 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15712 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(20): bicyclic nucleic acid (BNA)
tcaaggaagatggcatttct

SEQ ID NO: 15713 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(20): bicyclic nucleic acid (BNA)
tcaaggaagatggcatttct

SEQ ID NO: 15714 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15715 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15716 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15717 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15718 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (21)..(22): bicyclic nucleic acid (BNA)
tcaaggaagatggcatttctag

SEQ ID NO: 15719 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (21)..(22): bicyclic nucleic acid (BNA)
tcaaggaagatggcatttctag

SEQ ID NO: 15720 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15721 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15722 - DNA, 22 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15723 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15724 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15725 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15726 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15727 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15728 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
tcaaggaagatggcatttct

SEQ ID NO: 15729 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (19)..(20): bicyclic nucleic acid (BNA)
tcaaggaagatggcatttct

SEQ ID NO: 15730 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15731 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15732 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
tcaaggaagatggcatttct

SEQ ID NO: 15733 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15734 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (19)..(20): bicyclic nucleic acid (BNA)
tcaaggaagatggcatttct

SEQ ID NO: 15735 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15736 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (19)..(20): bicyclic nucleic acid (BNA)
tcaaggaagatggcatttct

SEQ ID NO: 15737 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
tcaaggaagatggcatttct

SEQ ID NO: 15738 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
tcaaggaagatggcatttct

SEQ ID NO: 15739 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15740 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15741 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15742 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15743 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15744 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
tcaaggaagatggcatttctag

SEQ ID NO: 15745 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (21)..(22): bicyclic nucleic acid (BNA)
tcaaggaagatggcatttctag

SEQ ID NO: 15746 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15747 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15748 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15749 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15750 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
tcaaggaagatggcatttctag

SEQ ID NO: 15751 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15752 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (21)..(22): bicyclic nucleic acid (BNA)
tcaaggaagatggcatttctag

SEQ ID NO: 15753 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15754 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15755 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (21)..(22): bicyclic nucleic acid (BNA)
tcaaggaagatggcatttctag

SEQ ID NO: 15756 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
tcaaggaagatggcatttctag

SEQ ID NO: 15757 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
tcaaggaagatggcatttctag

SEQ ID NO: 15758 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15759 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
tcaaggaagatggcatttctag

SEQ ID NO: 15760 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15761 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15762 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15763 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15764 - DNA, 18 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15765 - DNA, 18 bp, Artificial Sequence
  Description of Artificial Sequence: Synthetic Antisense oligonucleotide
  misc_feature (1)..(2): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15766 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15767 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15768 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15769 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15770 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15771 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15772 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15773 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15774 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15775 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15776 - DNA, 18 bp, Artificial Sequence
  Description of Artificial Sequence: Synthetic Antisense oligonucleotide
  misc_feature (1)..(2): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15777 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (17)..(18): bicyclic nucleic acid (BNA)
ctgtccaagcccggttga

SEQ ID NO: 15778 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15779 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15780 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 15781 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15782 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 15783 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15784 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15785 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15786 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15787 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15788 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15789 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15790 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15791 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15792 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15793 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15794 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15795 - DNA, 18 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 15796 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (8)..(8): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15797 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15798 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15799 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15800 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15801 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15802 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15803 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15804 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15805 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15806 - DNA, 18 bp, Artificial Sequence
  Description of Artificial Sequence: Synthetic Antisense oligonucleotide
  misc_feature (1)..(2): bicyclic nucleic acid (BNA)
  misc_feature (8)..(8): bicyclic nucleic acid (BNA)
  misc_feature (10)..(10): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15807 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15808 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15809 - DNA, 18 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (16)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15810 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 15811 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15812 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15813 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15814 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15815 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15816 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15817 - DNA, 18 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15818 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15819 - DNA, 18 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15820 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (10)..(10): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15821 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (6)..(6): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15822 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(4): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15823 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (15)..(15): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15824 - DNA, 18 bp, Artificial Sequence
  Description of Artificial Sequence: Synthetic Antisense oligonucleotide
  misc_feature (1)..(2): bicyclic nucleic acid (BNA)
  misc_feature (4)..(5): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15825 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 15826 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15827 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15828 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(12): bicyclic nucleic acid (BNA)
  misc_feature (17)..(18): bicyclic nucleic acid (BNA)
ctgtccaagcccggttga

SEQ ID NO: 15829 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15830 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15831 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15832 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(10): bicyclic nucleic acid (BNA)
  misc_feature (17)..(18): bicyclic nucleic acid (BNA)
ctgtccaagcccggttga

SEQ ID NO: 15833 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15834 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15835 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (6)..(6): bicyclic nucleic acid (BNA)
  misc_feature (17)..(18): bicyclic nucleic acid (BNA)
ctgtccaagcccggttga

SEQ ID NO: 15836 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (17)..(18): bicyclic nucleic acid (BNA)
ctgtccaagcccggttga

SEQ ID NO: 15837 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15838 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (10)..(10): bicyclic nucleic acid (BNA)
  misc_feature (17)..(18): bicyclic nucleic acid (BNA)
ctgtccaagcccggttga

SEQ ID NO: 15839 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (13)..(14): bicyclic nucleic acid (BNA)
  misc_feature (17)..(18): bicyclic nucleic acid (BNA)
ctgtccaagcccggttga

SEQ ID NO: 15840 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15841 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15842 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15843 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15844 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15845 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15846 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15847 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15848 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15849 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(6): bicyclic nucleic acid (BNA)
  misc_feature (17)..(18): bicyclic nucleic acid (BNA)
ctgtccaagcccggttga

SEQ ID NO: 15850 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (11)..(11): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15851 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15852 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15853 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(11): bicyclic nucleic acid (BNA)
  misc_feature (17)..(18): bicyclic nucleic acid (BNA)
ctgtccaagcccggttga

SEQ ID NO: 15854 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (12)..(13): bicyclic nucleic acid (BNA)
  misc_feature (17)..(18): bicyclic nucleic acid (BNA)
ctgtccaagcccggttga

SEQ ID NO: 15855 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15856 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (14)..(14): bicyclic nucleic acid (BNA)
  misc_feature (17)..(18): bicyclic nucleic acid (BNA)
ctgtccaagcccggttga

SEQ ID NO: 15857 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ctgtccaagcccggttga

SEQ ID NO: 15858 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15859 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (12)..(12): bicyclic nucleic acid (BNA)
  misc_feature (17)..(18): bicyclic nucleic acid (BNA)
ctgtccaagcccggttga

SEQ ID NO: 15860 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(3): bicyclic nucleic acid (BNA)
  misc_feature (5)..(5): bicyclic nucleic acid (BNA)
  misc_feature (17)..(18): bicyclic nucleic acid (BNA)
ctgtccaagcccggttga

SEQ ID NO: 15861 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(2): bicyclic nucleic acid (BNA)
  misc_feature (10)..(10): bicyclic nucleic acid (BNA)
  misc_feature (13)..(13): bicyclic nucleic acid (BNA)
  misc_feature (17)..(18): bicyclic nucleic acid (BNA)
ctgtccaagcccggttga

SEQ ID NO: 15862 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15863 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15864 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15865 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15866 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15867 - DNA, 20 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15868 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15869 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15870 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15871 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15872 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15873 - DNA, 22 bp, Artificial Sequence
  Description of Artificial Sequence: Synthetic Antisense oligonucleotide
  misc_feature (1)..(2): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15874 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15875 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15876 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15877 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15878 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15879 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15880 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15881 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15882 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15883 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15884 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15885 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15886 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15887 - DNA, 20 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15888 - DNA, 20 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15889 - DNA, 20 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (19)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 15890 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15891 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15892 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15893 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15894 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15895 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (9)..(9): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15896 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15897 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15898 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15899 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15900 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15901 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(12): bicyclic nucleic acid (BNA)
  misc_feature (14)..(14): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15902 - DNA, 22 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15903 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(6): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15904 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15905 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15906 - DNA, 22 bp, Artificial Sequence
  Description of Artificial Sequence: Synthetic Antisense oligonucleotide
  misc_feature (1)..(2): bicyclic nucleic acid (BNA)
  misc_feature (12)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15907 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (12)..(12): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15908 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15909 - DNA, 22 bp, Artificial Sequence
  Description of Artificial Sequence: Synthetic Antisense oligonucleotide
  misc_feature (1)..(2): bicyclic nucleic acid (BNA)
  misc_feature (14)..(14): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15910 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (19)..(19): bicyclic nucleic acid (BNA)
  misc_feature (21)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 15911 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gguaaguucuguccaagc

SEQ ID NO: 15912 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
gguaaguuctguccaagc

SEQ ID NO: 15913 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
gguaaguucuguccaagc

SEQ ID NO: 15914 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
gguaaguucuguccaagc

SEQ ID NO: 15915 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 15916 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 15917 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
gguaaguucuguccaagc

SEQ ID NO: 15918 - RNA, 18 nt, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
gguaaguucuguccaagc

SEQ ID NO: 15919 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
gguaaguucuguccaagc

SEQ ID NO: 15920 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
gguaaguucuguccaagc

SEQ ID NO: 15921 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
gguaaguucuguccaagc

SEQ ID NO: 15922 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gguaaguucuguccaagc

SEQ ID NO: 15923 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
guaaguucuguccaagcc

SEQ ID NO: 15924 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
guaaguucuguccaagcc

SEQ ID NO: 15925 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
agucgguaaguucugucc

SEQ ID NO: 15926 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 15927 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15928 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15929 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15930 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agucgguaaguucugucc

SEQ ID NO: 15931 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15932 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15933 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15934 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agucgguaaguucugucc

SEQ ID NO: 15935 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
cuguccaagcccgguuga

SEQ ID NO: 15936 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 15937 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 15938 - RNA, 18 nt, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 15939 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 15940 - RNA, 18 nt, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
cuguccaagcccgguuga

SEQ ID NO: 15941 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 15942 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 15943 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 15944 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 15945 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 15946 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
taaguucuguccaag

SEQ ID NO: 15947 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
taaguucuguccaag

SEQ ID NO: 15948 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuucu

SEQ ID NO: 15949 - RNA, 20 nt, Artificial Sequence
  Description of Artificial Sequence: Synthetic Antisense oligonucleotide
  misc_feature (5)..(5): bicyclic nucleic acid (BNA)
ucaaggaagauggcauuucu

SEQ ID NO: 15950 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
tcaaggaagauggcauuuct

SEQ ID NO: 15951 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuucu

SEQ ID NO: 15952 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
tcaaggaagauggcauuucu

SEQ ID NO: 15953 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(20): bicyclic nucleic acid (BNA)
tcaaggaagauggcauuuct

SEQ ID NO: 15954 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (20)..(20): bicyclic nucleic acid (BNA)
tcaaggaagauggcauuuct

SEQ ID NO: 15955 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
tcaaggaagauggcauuuct

SEQ ID NO: 15956 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
tcaaggaagauggcauuuct

SEQ ID NO: 15957 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): bicyclic nucleic acid (BNA)
  misc_feature (11)..(11): bicyclic nucleic acid (BNA)
  misc_feature (15)..(15): bicyclic nucleic acid (BNA)
  misc_feature (20)..(20): bicyclic nucleic acid (BNA)
tcaaggaagatggcauuuct

SEQ ID NO: 15958 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (15)..(15): bicyclic nucleic acid (BNA)
  misc_feature (20)..(20): bicyclic nucleic acid (BNA)
tcaaggaagauggcauuuct

SEQ ID NO: 15959 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
tcaaggaagauggcauuuct

SEQ ID NO: 15960 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 15961 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 15962 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagauggcauuuct

SEQ ID NO: 15963 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
tcaaggaagauggcauuucuag

SEQ ID NO: 15964 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
tcaaggaagauggcauuucuag

SEQ ID NO: 15965 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
tcaaggaagauggcauuucuag

SEQ ID NO: 15966 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(22): bicyclic nucleic acid (BNA)
tcaaggaagauggcauuucuag

SEQ ID NO: 15967 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (22)..(22): bicyclic nucleic acid (BNA)
tcaaggaagauggcauuucuag

SEQ ID NO: 15968 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (22)..(22): bicyclic nucleic acid (BNA)
tcaaggaagauggcauuucuag

SEQ ID NO: 15969 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 15970 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
tcaaggaagauggcauuucuag

SEQ ID NO: 15971 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 15972 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagauggcauuucuag

SEQ ID NO: 15973 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
tcaaggaagauggcat

SEQ ID NO: 15974 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
tcaaggaagauggcat

SEQ ID NO: 15975 - RNA, 16 nt, Artificial Sequence
  Description of Artificial Sequence: Synthetic Antisense oligonucleotide
  misc_feature (13)..(13): bicyclic nucleic acid (BNA)
ucaaggaagauggcau

SEQ ID NO: 15976 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
  misc_feature (15)..(15): bicyclic nucleic acid (BNA)
gaagauggcauuuct

SEQ ID NO: 15977 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15978 - DNA, 18 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguuctguccaagc

SEQ ID NO: 15979 - RNA, 18 nt, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15980 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15981 - RNA, 18 nt, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15982 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15983 - RNA, 18 nt, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15984 - RNA, 18 nt, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15985 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15986 - RNA, 18 nt, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15987 - RNA, 18 nt, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15988 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
gguaaguucuguccaagc

SEQ ID NO: 15989 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 15990 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
guaaguucuguccaagcc

SEQ ID NO: 15991 - RNA, 18 nt, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15992 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15993 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15994 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15995 - RNA, 18 nt, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15996 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15997 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15998 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 15999 - RNA, 18 nt, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 16000 - RNA, 18 nt, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agucgguaaguucugucc

SEQ ID NO: 16001 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (18)..(18): bicyclic nucleic acid (BNA)
cuguccaagcccgguuga

SEQ ID NO: 16002 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 16003 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
cuguccaagcccgguuga

SEQ ID NO: 16004 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 16005 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 16006 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
cuguccaagcccgguuga

SEQ ID NO: 16007 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 16008 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 16009 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 16010 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
cuguccaagcccgguuga

SEQ ID NO: 16011 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
cuguccaagcccgguuga

SEQ ID NO: 16012 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (15)..(15): bicyclic nucleic acid (BNA)
  misc_feature (7)..(7): 5-methyl
  misc_feature (11)..(12): 5-methyl
taaguucuguccaag

SEQ ID NO: 16013 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (7)..(7): 5-methyl
  misc_feature (11)..(12): 5-methyl
taaguucuguccaag

SEQ ID NO: 16014 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 16015 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
ucaaggaagauggcauuucu

SEQ ID NO: 16016 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16017 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 16018 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucu

SEQ ID NO: 16019 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16020 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16021 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16022 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16023 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (7)..(7): bicyclic nucleic acid (BNA)
  misc_feature (11)..(11): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcauuuct

SEQ ID NO: 16024 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16025 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16026 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16027 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16028 - DNA, 20 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuuct

SEQ ID NO: 16029 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16030 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16031 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16032 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16033 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16034 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16035 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16036 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16037 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16038 - DNA, 22 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagauggcauuucuag

SEQ ID NO: 16039 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (14)..(14): 5-methyl
tcaaggaagauggcat

SEQ ID NO: 16040 - DNA, 16 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (2)..(2): 5-methyl
  misc_feature (14)..(14): 5-methyl
tcaaggaagauggcat

SEQ ID NO: 16041 - RNA, 16 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (13)..(13): bicyclic nucleic acid (BNA)
ucaaggaagauggcau

SEQ ID NO: 16042 - DNA, 15 bp, Artificial Sequence
  Description of Artificial Sequence: Synthetic Antisense oligonucleotide
  Description of Combined DNA/RNA Molecule: Synthetic Antisense oligonucleotide
  misc_feature (1)..(1): bicyclic nucleic acid (BNA)
  misc_feature (8)..(8): bicyclic nucleic acid (BNA)
  misc_feature (15)..(15): bicyclic nucleic acid (BNA)
  misc_feature (9)..(9): 5-methyl
  misc_feature (14)..(14): 5-methyl
gaagauggcauuuct

SEQ ID NO: 16043 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ggtaagttctgtccaagc

SEQ ID NO: 16044 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
ggtaagttctgtccaagc

SEQ ID NO: 16045 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
ggtaagttctgtccaagc

SEQ ID NO: 16046 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
ggtaagttctgtccaagc

SEQ ID NO: 16047 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 16048 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 16049 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
ggtaagttctgtccaagc

SEQ ID NO: 16050 - DNA, 18 bp, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
ggtaagttctgtccaagc

SEQ ID NO: 16051 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
ggtaagttctgtccaagc

SEQ ID NO: 16052 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
ggtaagttctgtccaagc

SEQ ID NO: 16053 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
ggtaagttctgtccaagc

SEQ ID NO: 16054 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ggtaagttctgtccaagc

SEQ ID NO: 16055 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
gtaagttctgtccaagcc

SEQ ID NO: 16056 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
gtaagttctgtccaagcc

SEQ ID NO: 16057 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
agtcggtaagttctgtcc

SEQ ID NO: 16058 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 16059 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16060 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16061 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16062 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
agtcggtaagttctgtcc

SEQ ID NO: 16063 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16064 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16065 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16066 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
agtcggtaagttctgtcc

SEQ ID NO: 16067 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
ctgtccaagcccggttga

SEQ ID NO: 16068 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 16069 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 16070 - DNA, 18 bp, Artificial Sequence
  Description of Artificial Sequence: Synthetic Antisense oligonucleotide
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 16071 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16072 - DNA, 18 bp, Artificial Sequence
  Description of Artificial Sequence: Synthetic Antisense oligonucleotide
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
ctgtccaagcccggttga

SEQ ID NO: 16073 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16074 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16075 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16076 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16077 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 16078 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
taagttctgtccaag

SEQ ID NO: 16079 - DNA, 15 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
taagttctgtccaag

SEQ ID NO: 16080 - DNA, 20 bp, Artificial Sequence
  Description of Artificial Sequence: Synthetic Antisense oligonucleotide
  misc_feature (1)..(1): bicyclic nucleic acid (BNA)
tcaaggaagatggcatttct

SEQ ID NO: 16081 - DNA, 20 bp, Artificial Sequence
  Description of Artificial Sequence: Synthetic Antisense oligonucleotide
  misc_feature (5)..(5): bicyclic nucleic acid (BNA)
tcaaggaagatggcatttct

SEQ ID NO: 16082 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
tcaaggaagatggcatttct

SEQ ID NO: 16083 - DNA, 20 bp, Artificial Sequence
  Description of Artificial Sequence: Synthetic Antisense oligonucleotide
  misc_feature (1)..(2): bicyclic nucleic acid (BNA)
tcaaggaagatggcatttct

SEQ ID NO: 16084 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
tcaaggaagatggcatttct

SEQ ID NO: 16085 - DNA, 20 bp, Artificial Sequence
  Description of Artificial Sequence: Synthetic Antisense oligonucleotide
  misc_feature (1)..(2): bicyclic nucleic acid (BNA)
  misc_feature (20)..(20): bicyclic nucleic acid (BNA)
tcaaggaagatggcatttct

SEQ ID NO: 16086 - DNA, 20 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (20)..(20): bicyclic nucleic acid (BNA)
tcaaggaagatggcatttct

SEQ ID NO: 16087 - DNA, 20 bp, Artificial Sequence
  Description of Artificial Sequence: Synthetic Antisense oligonucleotide
  misc_feature (1)..(1): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
tcaaggaagatggcatttct

SEQ ID NO: 16088 - DNA, 20 bp, Artificial Sequence
  Description of Artificial Sequence: Synthetic Antisense oligonucleotide
  misc_feature (1)..(2): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
tcaaggaagatggcatttct

SEQ ID NO: 16089 - DNA, 20 bp, Artificial Sequence
  Description of Artificial Sequence: Synthetic Antisense oligonucleotide
  misc_feature (1)..(2): bicyclic nucleic acid (BNA)
  misc_feature (7)..(7): bicyclic nucleic acid (BNA)
  misc_feature (11)..(11): bicyclic nucleic acid (BNA)
  misc_feature (15)..(15): bicyclic nucleic acid (BNA)
  misc_feature (20)..(20): bicyclic nucleic acid (BNA)
tcaaggaagatggcatttct

SEQ ID NO: 16090 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (15)..(15): bicyclic nucleic acid (BNA)
  misc_feature (20)..(20): bicyclic nucleic acid (BNA)
tcaaggaagatggcatttct

SEQ ID NO: 16091 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
tcaaggaagatggcatttct

SEQ ID NO: 16092 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 16093 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 16094 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
tcaaggaagatggcatttct

SEQ ID NO: 16095 - DNA, 22 bp, Artificial Sequence
  Description of Artificial Sequence: Synthetic Antisense oligonucleotide
  misc_feature (1)..(1): bicyclic nucleic acid (BNA)
tcaaggaagatggcatttctag

SEQ ID NO: 16096 - DNA, 22 bp, Artificial Sequence
  Description of Artificial Sequence: Synthetic Antisense oligonucleotide
  misc_feature (1)..(2): bicyclic nucleic acid (BNA)
tcaaggaagatggcatttctag

SEQ ID NO: 16097 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
tcaaggaagatggcatttctag

SEQ ID NO: 16098 - DNA, 22 bp, Artificial Sequence
  Description of Artificial Sequence: Synthetic Antisense oligonucleotide
  misc_feature (1)..(2): bicyclic nucleic acid (BNA)
  misc_feature (22)..(22): bicyclic nucleic acid (BNA)
tcaaggaagatggcatttctag

SEQ ID NO: 16099 - DNA, 22 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (22)..(22): bicyclic nucleic acid (BNA)
tcaaggaagatggcatttctag

SEQ ID NO: 16100 - DNA, 22 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (22)..(22): bicyclic nucleic acid (BNA)
tcaaggaagatggcatttctag

SEQ ID NO: 16101 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 16102 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
tcaaggaagatggcatttctag

SEQ ID NO: 16103 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 16104 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
tcaaggaagatggcatttctag

SEQ ID NO: 16105 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
tcaaggaagatggcat

SEQ ID NO: 16106 - DNA, 16 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
tcaaggaagatggcat

SEQ ID NO: 16107 - DNA, 16 bp, Artificial Sequence
  Description of Artificial Sequence: Synthetic Antisense oligonucleotide
  misc_feature (13)..(13): bicyclic nucleic acid (BNA)
tcaaggaagatggcat

SEQ ID NO: 16108 - DNA, 15 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (15)..(15): bicyclic nucleic acid (BNA)
gaagatggcatttct

SEQ ID NO: 16109 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16110 - DNA, 18 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16111 - DNA, 18 bp, Artificial Sequence
  Description of Artificial Sequence: Synthetic Antisense oligonucleotide
  misc_feature (1)..(2): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16112 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16113 - DNA, 18 bp, Artificial Sequence
  Description of Artificial Sequence: Synthetic Antisense oligonucleotide
  misc_feature (1)..(2): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16114 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16115 - DNA, 18 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (11)..(11): bicyclic nucleic acid (BNA)
  misc_feature (17)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16116 - DNA, 18 bp, Artificial Sequence
  Description of Artificial Sequence: Synthetic Antisense oligonucleotide
  misc_feature (1)..(2): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16117 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16118 - DNA, 18 bp, Artificial Sequence
  Description of Artificial Sequence: Synthetic Antisense oligonucleotide
  misc_feature (1)..(1): bicyclic nucleic acid (BNA)
  misc_feature (11)..(11): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16119 - DNA, 18 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16120 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (9)..(9): 5-methyl
  misc_feature (13)..(14): 5-methyl
  misc_feature (18)..(18): 5-methyl
ggtaagttctgtccaagc

SEQ ID NO: 16121 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 16122 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (8)..(8): 5-methyl
  misc_feature (12)..(13): 5-methyl
  misc_feature (17)..(18): 5-methyl
gtaagttctgtccaagcc

SEQ ID NO: 16123 - DNA, 18 bp, Artificial Sequence
  Description of Artificial Sequence: Synthetic Antisense oligonucleotide
  misc_feature (1)..(1): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16124 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16125 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16126 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16127 - DNA, 18 bp, Artificial Sequence
  Description of Artificial Sequence: Synthetic Antisense oligonucleotide
  misc_feature (1)..(1): bicyclic nucleic acid (BNA)
  misc_feature (10)..(10): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16128 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (10)..(10): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16129 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16130 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16131 - DNA, 18 bp, Artificial Sequence
  Description of Artificial Sequence: Synthetic Antisense oligonucleotide
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16132 - DNA, 18 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
  misc_feature (4)..(4): 5-methyl
  misc_feature (13)..(13): 5-methyl
  misc_feature (17)..(18): 5-methyl
agtcggtaagttctgtcc

SEQ ID NO: 16133 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (18)..(18): bicyclic nucleic acid (BNA)
ctgtccaagcccggttga

SEQ ID NO: 16134 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 16135 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (18)..(18): bicyclic nucleic acid (BNA)
ctgtccaagcccggttga

SEQ ID NO: 16136 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 16137 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16138 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (13)..(14): bicyclic nucleic acid (BNA)
  misc_feature (18)..(18): bicyclic nucleic acid (BNA)
ctgtccaagcccggttga

SEQ ID NO: 16139 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (6)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16140 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(6): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16141 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (5)..(5): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16142 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (18)..(18): bicyclic nucleic acid (BNA)
ctgtccaagcccggttga

SEQ ID NO: 16143 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
  misc_feature (1)..(1): bicyclic nucleic acid (BNA)
  misc_feature (9)..(9): bicyclic nucleic acid (BNA)
  misc_feature (14)..(14): bicyclic nucleic acid (BNA)
  misc_feature (18)..(18): bicyclic nucleic acid (BNA)
ctgtccaagcccggttga

SEQ ID NO: 16144 - DNA, 15 bp, Artificial Sequence
  Description of Artificial Sequence: Synthetic Antisense oligonucleotide
  misc_feature (1)..(1): bicyclic nucleic acid (BNA)
  misc_feature (15)..(15): bicyclic nucleic acid (BNA)
  misc_feature (7)..(7): 5-methyl
  misc_feature (11)..(12): 5-methyl
taagttctgtccaag

SEQ ID NO: 16145 - DNA, 15 bp, Artificial Sequence
  Description of Artificial Sequence: Synthetic Antisense oligonucleotide
  misc_feature (1)..(1): bicyclic nucleic acid (BNA)
  misc_feature (4)..(4): bicyclic nucleic acid (BNA)
  misc_feature (15)..(15): bicyclic nucleic acid (BNA)
  misc_feature (7)..(7): 5-methyl
  misc_feature (11)..(12): 5-methyl
taagttctgtccaag

SEQ ID NO: 16146 - DNA, 20 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16147 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
  misc_feature (5)..(5): bicyclic nucleic acid (BNA)
tcaaggaagatggcatttct

SEQ ID NO: 16148 - DNA, 20 bp, Artificial Sequence
  Description of Artificial Sequence: Synthetic Antisense oligonucleotide
  misc_feature (1)..(1): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16149 - DNA, 20 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16150 - DNA, 20 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16151 - DNA, 20 bp, Artificial Sequence
  Description of Artificial Sequence: Synthetic Antisense oligonucleotide
  misc_feature (1)..(2): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16152 - DNA, 20 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16153 - DNA, 20 bp, Artificial Sequence
  Description of Artificial Sequence: Synthetic Antisense oligonucleotide
  misc_feature (1)..(1): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16154 - DNA, 20 bp, Artificial Sequence
  Description of Artificial Sequence: Synthetic Antisense oligonucleotide
  misc_feature (1)..(2): bicyclic nucleic acid (BNA)
  misc_feature (7)..(7): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16155 - DNA, 20 bp, Artificial Sequence
  Description of Artificial Sequence: Synthetic Antisense oligonucleotide
  misc_feature (1)..(2): bicyclic nucleic acid (BNA)
  misc_feature (7)..(7): bicyclic nucleic acid (BNA)
  misc_feature (11)..(11): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16156 - DNA, 20 bp, Artificial Sequence
  Description of Artificial Sequence: Synthetic Antisense oligonucleotide
  misc_feature (1)..(2): bicyclic nucleic acid (BNA)
  misc_feature (6)..(6): bicyclic nucleic acid (BNA)
  misc_feature (10)..(10): bicyclic nucleic acid (BNA)
  misc_feature (15)..(15): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16157 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16158 - DNA, 20 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16159 - DNA, 20 bp, Artificial Sequence
  Description of Artificial Sequence: Synthetic Antisense oligonucleotide
  misc_feature (1)..(1): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16160 - DNA, 20 bp, Artificial Sequence
  Description of Artificial Sequence: Synthetic Antisense oligonucleotide
  misc_feature (1)..(1): bicyclic nucleic acid (BNA)
  misc_feature (6)..(6): bicyclic nucleic acid (BNA)
  misc_feature (9)..(9): bicyclic nucleic acid (BNA)
  misc_feature (13)..(13): bicyclic nucleic acid (BNA)
  misc_feature (20)..(20): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttct

SEQ ID NO: 16161 - DNA, 22 bp, Artificial Sequence
  Description of Artificial Sequence: Synthetic Antisense oligonucleotide
  misc_feature (1)..(1): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16162 - DNA, 22 bp, Artificial Sequence
  Description of Artificial Sequence: Synthetic Antisense oligonucleotide
  misc_feature (1)..(2): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16163 - DNA, 22 bp, Artificial Sequence
  Description of Artificial Sequence: Synthetic Antisense oligonucleotide
  misc_feature (1)..(1): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16164 - DNA, 22 bp, Artificial Sequence
  Description of Artificial Sequence: Synthetic Antisense oligonucleotide
  misc_feature (1)..(2): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16165 - DNA, 22 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16166 - DNA, 22 bp, Artificial Sequence
  Description of Artificial Sequence: Synthetic Antisense oligonucleotide
  misc_feature (1)..(2): bicyclic nucleic acid (BNA)
  misc_feature (10)..(10): bicyclic nucleic acid (BNA)
  misc_feature (15)..(15): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16167 - DNA, 22 bp, Artificial Sequence
  Description of Artificial Sequence: Synthetic Antisense oligonucleotide
  misc_feature (1)..(2): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16168 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16169 - DNA, 22 bp, Artificial Sequence
  Description of Artificial Sequence: Synthetic Antisense oligonucleotide
  misc_feature (1)..(2): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16170 - DNA, 22 bp, Artificial Sequence
  Description of Artificial Sequence: Synthetic Antisense oligonucleotide
  misc_feature (1)..(2): bicyclic nucleic acid (BNA)
  misc_feature (5)..(5): bicyclic nucleic acid (BNA)
  misc_feature (9)..(9): bicyclic nucleic acid (BNA)
  misc_feature (13)..(13): bicyclic nucleic acid (BNA)
  misc_feature (22)..(22): bicyclic nucleic acid (BNA)
  misc_feature (2)..(2): 5-methyl
  misc_feature (14)..(14): 5-methyl
  misc_feature (19)..(19): 5-methyl
tcaaggaagatggcatttctag

SEQ ID NO: 16171 - DNA, 16 bp, Artificial Sequence
  Description of Artificial Sequence: Synthetic Antisense oligonucleotide
  misc_feature (1)..(1): bicyclic nucleic acid (BNA)
  misc_feature (16)..(16): bicyclic nucleic acid (BNA)
  misc_feature (2)..(2): 5-methyl
  misc_feature (14)..(14): 5-methyl
tcaaggaagatggcat

SEQ ID NO: 16172 - DNA, 16 bp, Artificial Sequence
  Description of Artificial Sequence: Synthetic Antisense oligonucleotide
  misc_feature (1)..(1): bicyclic nucleic acid (BNA)
  misc_feature (13)..(13): bicyclic nucleic acid (BNA)
  misc_feature (16)..(16): bicyclic nucleic acid (BNA)
  misc_feature (2)..(2): 5-methyl
  misc_feature (14)..(14): 5-methyl
tcaaggaagatggcat

SEQ ID NO: 16173 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (13)..(13): bicyclic nucleic acid (BNA)
tcaaggaagatggcat

SEQ ID NO: 16174 - DNA, 15 bp, Artificial Sequence
  Description of Artificial Sequence: Synthetic Antisense oligonucleotide
  misc_feature (1)..(1): bicyclic nucleic acid (BNA)
  misc_feature (8)..(8): bicyclic nucleic acid (BNA)
  misc_feature (15)..(15): bicyclic nucleic acid (BNA)
  misc_feature (9)..(9): 5-methyl
  misc_feature (14)..(14): 5-methyl
gaagatggcatttct

SEQ ID NO: 16175 - RNA, 18 nt, Artificial Sequence
  Description of Artificial Sequence: Synthetic Antisense oligonucleotide
gguaaguucuguccaagc

SEQ ID NO: 16176 - RNA, 20 nt, Artificial Sequence
  Description of Artificial Sequence: Synthetic Antisense oligonucleotide
ucaaggaagauggcauuucu

SEQ ID NO: 16177 - RNA, 18 nt, Artificial Sequence
  Description of Artificial Sequence: Synthetic Antisense oligonucleotide
gguaaguucuguccaagc

SEQ ID NO: 16178 - RNA, 20 nt, Artificial Sequence
  Description of Artificial Sequence: Synthetic Antisense oligonucleotide
ucaaggaagauggcauuucu

SEQ ID NO: 16179 - RNA, 18 nt, Artificial Sequence
  Description of Artificial Sequence: Synthetic Antisense oligonucleotide
gguaaguucuguccaagc

SEQ ID NO: 16180 - RNA, 22 nt, Artificial Sequence
  Description of Artificial Sequence: Synthetic Antisense oligonucleotide
ucaaggaagauggcauuucuag

SEQ ID NO: 16181 - RNA, 18 nt, Artificial Sequence
  Description of Artificial Sequence: Synthetic Antisense oligonucleotide
gguaaguucuguccaagc

SEQ ID NO: 16182 - RNA, 22 nt, Artificial Sequence
  Description of Artificial Sequence: Synthetic Antisense oligonucleotide
ucaaggaagauggcauuucuag

SEQ ID NO: 16183 - RNA, 18 nt, Artificial Sequence
  Description of Artificial Sequence: Synthetic Antisense oligonucleotide
guaaguucuguccaagcc

SEQ ID NO: 16184 - RNA, 20 nt, Artificial Sequence
  Description of Artificial Sequence: Synthetic Antisense oligonucleotide
ucaaggaagauggcauuucu

SEQ ID NO: 16185 - RNA, 18 nt, Artificial Sequence
  Description of Artificial Sequence: Synthetic Antisense oligonucleotide
guaaguucuguccaagcc

SEQ ID NO: 16186 - RNA, 20 nt, Artificial Sequence
  Description of Artificial Sequence: Synthetic Antisense oligonucleotide
ucaaggaagauggcauuucu

SEQ ID NO: 16187 - RNA, 18 nt, Artificial Sequence
  Description of Artificial Sequence: Synthetic Antisense oligonucleotide
guaaguucuguccaagcc

SEQ ID NO: 16188 - RNA, 22 nt, Artificial Sequence
  Description of Artificial Sequence: Synthetic Antisense oligonucleotide
ucaaggaagauggcauuucuag

SEQ ID NO: 16189 - RNA, 18 nt, Artificial Sequence
  Description of Artificial Sequence: Synthetic Antisense oligonucleotide
guaaguucuguccaagcc

SEQ ID NO: 16190 - RNA, 22 nt, Artificial Sequence
  Description of Artificial Sequence: Synthetic Antisense oligonucleotide
ucaaggaagauggcauuucuag

SEQ ID NO: 16191 - RNA, 18 nt, Artificial Sequence
  Description of Artificial Sequence: Synthetic Antisense oligonucleotide
agucgguaaguucugucc

SEQ ID NO: 16192 - RNA, 20 nt, Artificial Sequence
  Description of Artificial Sequence: Synthetic Antisense oligonucleotide
ucaaggaagauggcauuucu

SEQ ID NO: 16193 - RNA, 18 nt, Artificial Sequence
  Description of Artificial Sequence: Synthetic Antisense oligonucleotide
agucgguaaguucugucc

SEQ ID NO: 16194 - RNA, 20 nt, Artificial Sequence
  Description of Artificial Sequence: Synthetic Antisense oligonucleotide
ucaaggaagauggcauuucu

SEQ ID NO: 16195 - RNA, 18 nt, Artificial Sequence
  Description of Artificial Sequence: Synthetic Antisense oligonucleotide
agucgguaaguucugucc

SEQ ID NO: 16196 - RNA, 22 nt, Artificial Sequence
  Description of Artificial Sequence: Synthetic Antisense oligonucleotide
ucaaggaagauggcauuucuag

SEQ ID NO: 16197 - RNA, 18 nt, Artificial Sequence
  Description of Artificial Sequence: Synthetic Antisense oligonucleotide
agucgguaaguucugucc

SEQ ID NO: 16198 - RNA, 22 nt, Artificial Sequence
  Description of Artificial Sequence: Synthetic Antisense oligonucleotide
ucaaggaagauggcauuucuag

SEQ ID NO: 16199 - RNA, 18 nt, Artificial Sequence
  Description of Artificial Sequence: Synthetic Antisense oligonucleotide
cuguccaagcccgguuga

SEQ ID NO: 16200 - RNA, 20 nt, Artificial Sequence
  Description of Artificial Sequence: Synthetic Antisense oligonucleotide
ucaaggaagauggcauuucu

SEQ ID NO: 16201 - RNA, 18 nt, Artificial Sequence
  Description of Artificial Sequence: Synthetic Antisense oligonucleotide
cuguccaagcccgguuga

SEQ ID NO: 16202 - RNA, 20 nt, Artificial Sequence
  Description of Artificial Sequence: Synthetic Antisense oligonucleotide
ucaaggaagauggcauuucu

SEQ ID NO: 16203 - RNA, 18 nt, Artificial Sequence
  Description of Artificial Sequence: Synthetic Antisense oligonucleotide
cuguccaagcccgguuga

SEQ ID NO: 16204 - RNA, 22 nt, Artificial Sequence
  Description of Artificial Sequence: Synthetic Antisense oligonucleotide
ucaaggaagauggcauuucuag

SEQ ID NO: 16205 - RNA, 18 nt, Artificial Sequence
  Description of Artificial Sequence: Synthetic Antisense oligonucleotide
cuguccaagcccgguuga

SEQ ID NO: 16206 - RNA, 22 nt, Artificial Sequence
  Description of Artificial Sequence: Synthetic Antisense oligonucleotide
ucaaggaagauggcauuucuag

SEQ ID NO: 16207 - RNA, 15 nt, Artificial Sequence
  Description of Artificial Sequence: Synthetic Antisense oligonucleotide
uaaguucuguccaag

SEQ ID NO: 16208 - RNA, 16 nt, Artificial Sequence
  Description of Artificial Sequence: Synthetic Antisense oligonucleotide
ucaaggaagauggcau

SEQ ID NO: 16209 - RNA, 15 nt, Artificial Sequence
  Description of Artificial Sequence: Synthetic Antisense oligonucleotide
uaaguucuguccaag

SEQ ID NO: 16210 - RNA, 16 nt, Artificial Sequence
  Description of Artificial Sequence: Synthetic Antisense oligonucleotide
ucaaggaagauggcau

SEQ ID NO: 16211 - RNA, 15 nt, Artificial Sequence
  Description of Artificial Sequence: Synthetic Antisense oligonucleotide
uaaguucuguccaag

SEQ ID NO: 16212 - RNA, 15 nt, Artificial Sequence
  Description of Artificial Sequence: Synthetic Antisense oligonucleotide
gaagauggcauuucu

SEQ ID NO: 16213 - RNA, 15 nt, Artificial Sequence
  Description of Artificial Sequence: Synthetic Antisense oligonucleotide
uaaguucuguccaag

SEQ ID NO: 16214 - RNA, 15 nt, Artificial Sequence
  Description of Artificial Sequence: Synthetic Antisense oligonucleotide
gaagauggcauuucu

SEQ ID NO: 16215 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16216 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16217 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16218 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16219 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16220 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16221 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16222 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16223 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16224 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16225 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16226 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16227 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16228 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16229 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16230 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16231 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16232 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16233 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16234 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16235 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16236 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16237 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16238 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16239 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16240 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16241 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16242 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16243 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16244 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16245 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16246 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16247 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16248 - RNA, 16 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcau

SEQ ID NO: 16249 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16250 - RNA, 16 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcau

SEQ ID NO: 16251 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16252 - RNA, 15 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucu

SEQ ID NO: 16253 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16254 - RNA, 15 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucu

SEQ ID NO: 16255 - DNA, 18 bp, Artificial Sequence
  Description of Artificial Sequence: Synthetic Antisense oligonucleotide
ggtaagttctgtccaagc

SEQ ID NO: 16256 - DNA, 20 bp, Artificial Sequence
  Description of Artificial Sequence: Synthetic Antisense oligonucleotide
tcaaggaagatggcatttct

SEQ ID NO: 16257 - DNA, 18 bp, Artificial Sequence
  Description of Artificial Sequence: Synthetic Antisense oligonucleotide
ggtaagttctgtccaagc

SEQ ID NO: 16258 - DNA, 20 bp, Artificial Sequence
  Description of Artificial Sequence: Synthetic Antisense oligonucleotide
tcaaggaagatggcatttct

SEQ ID NO: 16259 - DNA, 18 bp, Artificial Sequence
  Description of Artificial Sequence: Synthetic Antisense oligonucleotide
ggtaagttctgtccaagc

SEQ ID NO: 16260 - DNA, 22 bp, Artificial Sequence
  Description of Artificial Sequence: Synthetic Antisense oligonucleotide
tcaaggaagatggcatttctag

SEQ ID NO: 16261 - DNA, 18 bp, Artificial Sequence
  Description of Artificial Sequence: Synthetic Antisense oligonucleotide
ggtaagttctgtccaagc

SEQ ID NO: 16262 - DNA, 22 bp, Artificial Sequence
  Description of Artificial Sequence: Synthetic Antisense oligonucleotide
tcaaggaagatggcatttctag

SEQ ID NO: 16263 - DNA, 18 bp, Artificial Sequence
  Description of Artificial Sequence: Synthetic Antisense oligonucleotide
gtaagttctgtccaagcc

SEQ ID NO: 16264 - DNA, 20 bp, Artificial Sequence
  Description of Artificial Sequence: Synthetic Antisense oligonucleotide
tcaaggaagatggcatttct

SEQ ID NO: 16265 - DNA, 18 bp, Artificial Sequence
  Description of Artificial Sequence: Synthetic Antisense oligonucleotide
gtaagttctgtccaagcc

SEQ ID NO: 16266 - DNA, 20 bp, Artificial Sequence
  Description of Artificial Sequence: Synthetic Antisense oligonucleotide
tcaaggaagatggcatttct

SEQ ID NO: 16267 - DNA, 18 bp, Artificial Sequence
  Description of Artificial Sequence: Synthetic Antisense oligonucleotide
gtaagttctgtccaagcc

SEQ ID NO: 16268 - DNA, 22 bp, Artificial Sequence
  Description of Artificial Sequence: Synthetic Antisense oligonucleotide
tcaaggaagatggcatttctag

SEQ ID NO: 16269 - DNA, 18 bp, Artificial Sequence
  Description of Artificial Sequence: Synthetic Antisense oligonucleotide
gtaagttctgtccaagcc

SEQ ID NO: 16270 - DNA, 22 bp, Artificial Sequence
  Description of Artificial Sequence: Synthetic Antisense oligonucleotide
tcaaggaagatggcatttctag

SEQ ID NO: 16271 - DNA, 18 bp, Artificial Sequence
  Description of Artificial Sequence: Synthetic Antisense oligonucleotide
agtcggtaagttctgtcc

SEQ ID NO: 16272 - DNA, 20 bp, Artificial Sequence
  Description of Artificial Sequence: Synthetic Antisense oligonucleotide
tcaaggaagatggcatttct

SEQ ID NO: 16273 - DNA, 18 bp, Artificial Sequence
  Description of Artificial Sequence: Synthetic Antisense oligonucleotide
agtcggtaagttctgtcc

SEQ ID NO: 16274 - DNA, 20 bp, Artificial Sequence
  Description of Artificial Sequence: Synthetic Antisense oligonucleotide
tcaaggaagatggcatttct

SEQ ID NO: 16275 - DNA, 18 bp, Artificial Sequence
  Description of Artificial Sequence: Synthetic Antisense oligonucleotide
agtcggtaagttctgtcc

SEQ ID NO: 16276 - DNA, 22 bp, Artificial Sequence
  Description of Artificial Sequence: Synthetic Antisense oligonucleotide
tcaaggaagatggcatttctag

SEQ ID NO: 16277 - DNA, 18 bp, Artificial Sequence
  Description of Artificial Sequence: Synthetic Antisense oligonucleotide
agtcggtaagttctgtcc

SEQ ID NO: 16278 - DNA, 22 bp, Artificial Sequence
  Description of Artificial Sequence: Synthetic Antisense oligonucleotide
tcaaggaagatggcatttctag

SEQ ID NO: 16279 - DNA, 18 bp, Artificial Sequence
  Description of Artificial Sequence: Synthetic Antisense oligonucleotide
ctgtccaagcccggttga

SEQ ID NO: 16280 - DNA, 20 bp, Artificial Sequence
  Description of Artificial Sequence: Synthetic Antisense oligonucleotide
tcaaggaagatggcatttct

SEQ ID NO: 16281 - DNA, 18 bp, Artificial Sequence
  Description of Artificial Sequence: Synthetic Antisense oligonucleotide
ctgtccaagcccggttga

SEQ ID NO: 16282 - DNA, 20 bp, Artificial Sequence
  Description of Artificial Sequence: Synthetic Antisense oligonucleotide
tcaaggaagatggcatttct

SEQ ID NO: 16283 - DNA, 18 bp, Artificial Sequence
  Description of Artificial Sequence: Synthetic Antisense oligonucleotide
ctgtccaagcccggttga

SEQ ID NO: 16284 - DNA, 22 bp, Artificial Sequence
  Description of Artificial Sequence: Synthetic Antisense oligonucleotide
tcaaggaagatggcatttctag

SEQ ID NO: 16285 - DNA, 18 bp, Artificial Sequence
  Description of Artificial Sequence: Synthetic Antisense oligonucleotide
ctgtccaagcccggttga

SEQ ID NO: 16286 - DNA, 22 bp, Artificial Sequence
  Description of Artificial Sequence: Synthetic Antisense oligonucleotide
tcaaggaagatggcatttctag

SEQ ID NO: 16287 - DNA, 15 bp, Artificial Sequence
  Description of Artificial Sequence: Synthetic Antisense oligonucleotide
taagttctgtccaag

SEQ ID NO: 16288 - DNA, 16 bp, Artificial Sequence
  Description of Artificial Sequence: Synthetic Antisense oligonucleotide
tcaaggaagatggcat

SEQ ID NO: 16289 - DNA, 15 bp, Artificial Sequence
  Description of Artificial Sequence: Synthetic Antisense oligonucleotide
taagttctgtccaag

SEQ ID NO: 16290 - DNA, 16 bp, Artificial Sequence
  Description of Artificial Sequence: Synthetic Antisense oligonucleotide
tcaaggaagatggcat

SEQ ID NO: 16291 - DNA, 15 bp, Artificial Sequence
  Description of Artificial Sequence: Synthetic Antisense oligonucleotide
taagttctgtccaag

SEQ ID NO: 16292 - DNA, 15 bp, Artificial Sequence
  Description of Artificial Sequence: Synthetic Antisense oligonucleotide
gaagatggcatttct

SEQ ID NO: 16293 - DNA, 15 bp, Artificial Sequence
  Description of Artificial Sequence: Synthetic Antisense oligonucleotide
taagttctgtccaag

SEQ ID NO: 16294 - DNA, 15 bp, Artificial Sequence
  Description of Artificial Sequence: Synthetic Antisense oligonucleotide
gaagatggcatttct

SEQ ID NO: 16295 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16296 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16297 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16298 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16299 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16300 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16301 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16302 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16303 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16304 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16305 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16306 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16307 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16308 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16309 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16310 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16311 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16312 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16313 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16314 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16315 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16316 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16317 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16318 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16319 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16320 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16321 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16322 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16323 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16324 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16325 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16326 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16327 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16328 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcat

SEQ ID NO: 16329 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16330 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcat

SEQ ID NO: 16331 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16332 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttct

SEQ ID NO: 16333 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16334 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttct

SEQ ID NO: 16335 - RNA, 18 nt, Artificial Sequence
  Description of Artificial Sequence: Synthetic Antisense oligonucleotide
gguaaguucuguccaagc

SEQ ID NO: 16336 - DNA, 20 bp, Artificial Sequence
  Description of Artificial Sequence: Synthetic Antisense oligonucleotide
  Description of Combined DNA/RNA Molecule: Synthetic Antisense oligonucleotide
tcaaggaagauggcauuuct

SEQ ID NO: 16337 - RNA, 18 nt, Artificial Sequence
  Description of Artificial Sequence: Synthetic Antisense oligonucleotide
gguaaguucuguccaagc

SEQ ID NO: 16338 - DNA, 20 bp, Artificial Sequence
  Description of Artificial Sequence: Synthetic Antisense oligonucleotide
  Description of Combined DNA/RNA Molecule: Synthetic Antisense oligonucleotide
tcaaggaagauggcauuuct

SEQ ID NO: 16339 - DNA, 15 bp, Artificial Sequence
  Description of Artificial Sequence: Synthetic Antisense oligonucleotide
taagttctgtccaag

SEQ ID NO: 16340 - DNA, 15 bp, Artificial Sequence
  Description of Artificial Sequence: Synthetic Antisense oligonucleotide
gaagatggcatttct

SEQ ID NO: 16341 - DNA, 15 bp, Artificial Sequence
  Description of Artificial Sequence: Synthetic Antisense oligonucleotide
taagttctgtccaag

SEQ ID NO: 16342 - DNA, 15 bp, Artificial Sequence
  Description of Artificial Sequence: Synthetic Antisense oligonucleotide
gaagatggcatttct

SEQ ID NO: 16343 - DNA, 15 bp, Artificial Sequence
  Description of Artificial Sequence: Synthetic Antisense oligonucleotide
taagttctgtccaag

SEQ ID NO: 16344 - DNA, 16 bp, Artificial Sequence
  Description of Artificial Sequence: Synthetic Antisense oligonucleotide
tcaaggaagatggcat

SEQ ID NO: 16345 - DNA, 15 bp, Artificial Sequence
  Description of Artificial Sequence: Synthetic Antisense oligonucleotide
taagttctgtccaag

SEQ ID NO: 16346 - DNA, 16 bp, Artificial Sequence
  Description of Artificial Sequence: Synthetic Antisense oligonucleotide
tcaaggaagatggcat

SEQ ID NO: 16347 - DNA, 15 bp, Artificial Sequence
  Description of Artificial Sequence: Synthetic Antisense oligonucleotide
taagttctgtccaag

SEQ ID NO: 16348 - DNA, 16 bp, Artificial Sequence
  Description of Artificial Sequence: Synthetic Antisense oligonucleotide
tcaaggaagatggcat

SEQ ID NO: 16349 - DNA, 15 bp, Artificial Sequence
  Description of Artificial Sequence: Synthetic Antisense oligonucleotide
taagttctgtccaag

SEQ ID NO: 16350 - DNA, 16 bp, Artificial Sequence
  Description of Artificial Sequence: Synthetic Antisense oligonucleotide
tcaaggaagatggcat

SEQ ID NO: 16351 - DNA, 31 bp, Artificial Sequence
  Description of Artificial Sequence: Synthetic Antisense oligonucleotide
taagttctgtccaagtcaaggaagatggcat

SEQ ID NO: 16352 - DNA, 31 bp, Artificial Sequence
  Description of Artificial Sequence: Synthetic Antisense oligonucleotide
tcaaggaagatggcattaagttctgtccaag

SEQ ID NO: 16353 - DNA, 19 bp, Artificial Sequence
  Description of Artificial Sequence: Synthetic Antisense oligonucleotide
  Description of Combined DNA/RNA Molecule: Synthetic Antisense oligonucleotide
caaggaagauggcauuuct

SEQ ID NO: 16354 - RNA, 20 nt, Artificial Sequence
  Description of Artificial Sequence: Synthetic Antisense oligonucleotide
ucaaggaagauggcauuucu

SEQ ID NO: 16355 - RNA, 18 nt, Artificial Sequence
  Description of Artificial Sequence: Synthetic Antisense oligonucleotide
gguaaguucuguccaagc

SEQ ID NO: 16356 - RNA, 20 nt, Artificial Sequence
  Description of Artificial Sequence: Synthetic Antisense oligonucleotide
ucaaggaagauggcauuucu

SEQ ID NO: 16357 - RNA, 18 nt, Artificial Sequence
  Description of Artificial Sequence: Synthetic Antisense oligonucleotide
gguaaguucuguccaagc

SEQ ID NO: 16358 - RNA, 22 nt, Artificial Sequence
  Description of Artificial Sequence: Synthetic Antisense oligonucleotide
ucaaggaagauggcauuucuag

SEQ ID NO: 16359 - RNA, 18 nt, Artificial Sequence
  Description of Artificial Sequence: Synthetic Antisense oligonucleotide
gguaaguucuguccaagc

SEQ ID NO: 16360 - RNA, 22 nt, Artificial Sequence
  Description of Artificial Sequence: Synthetic Antisense oligonucleotide
ucaaggaagauggcauuucuag

SEQ ID NO: 16361 - RNA, 18 nt, Artificial Sequence
  Description of Artificial Sequence: Synthetic Antisense oligonucleotide
gguaaguucuguccaagc

SEQ ID NO: 16362 - RNA, 20 nt, Artificial Sequence
  Description of Artificial Sequence: Synthetic Antisense oligonucleotide
ucaaggaagauggcauuucu

SEQ ID NO: 16363 - RNA, 18 nt, Artificial Sequence
  Description of Artificial Sequence: Synthetic Antisense oligonucleotide
guaaguucuguccaagcc

SEQ ID NO: 16364 - RNA, 20 nt, Artificial Sequence
  Description of Artificial Sequence: Synthetic Antisense oligonucleotide
ucaaggaagauggcauuucu

SEQ ID NO: 16365 - RNA, 18 nt, Artificial Sequence
  Description of Artificial Sequence: Synthetic Antisense oligonucleotide
guaaguucuguccaagcc

SEQ ID NO: 16366 - RNA, 22 nt, Artificial Sequence
  Description of Artificial Sequence: Synthetic Antisense oligonucleotide
ucaaggaagauggcauuucuag

SEQ ID NO: 16367 - RNA, 18 nt, Artificial Sequence
  Description of Artificial Sequence: Synthetic Antisense oligonucleotide
guaaguucuguccaagcc

SEQ ID NO: 16368 - RNA, 22 nt, Artificial Sequence
  Description of Artificial Sequence: Synthetic Antisense oligonucleotide
ucaaggaagauggcauuucuag

SEQ ID NO: 16369 - RNA, 18 nt, Artificial Sequence
  Description of Artificial Sequence: Synthetic Antisense oligonucleotide
guaaguucuguccaagcc

SEQ ID NO: 16370 - RNA, 20 nt, Artificial Sequence
  Description of Artificial Sequence: Synthetic Antisense oligonucleotide
ucaaggaagauggcauuucu

SEQ ID NO: 16371 - RNA, 18 nt, Artificial Sequence
  Description of Artificial Sequence: Synthetic Antisense oligonucleotide
agucgguaaguucugucc

SEQ ID NO: 16372 - RNA, 20 nt, Artificial Sequence
  Description of Artificial Sequence: Synthetic Antisense oligonucleotide
ucaaggaagauggcauuucu

SEQ ID NO: 16373 - RNA, 18 nt, Artificial Sequence
  Description of Artificial Sequence: Synthetic Antisense oligonucleotide
agucgguaaguucugucc

SEQ ID NO: 16374 - RNA, 22 nt, Artificial Sequence
  Description of Artificial Sequence: Synthetic Antisense oligonucleotide
ucaaggaagauggcauuucuag

SEQ ID NO: 16375 - RNA, 18 nt, Artificial Sequence
  Description of Artificial Sequence: Synthetic Antisense oligonucleotide
agucgguaaguucugucc

SEQ ID NO: 16376 - RNA, 22 nt, Artificial Sequence
  Description of Artificial Sequence: Synthetic Antisense oligonucleotide
ucaaggaagauggcauuucuag

SEQ ID NO: 16377 - RNA, 18 nt, Artificial Sequence
  Description of Artificial Sequence: Synthetic Antisense oligonucleotide
agucgguaaguucugucc

SEQ ID NO: 16378 - RNA, 20 nt, Artificial Sequence
  Description of Artificial Sequence: Synthetic Antisense oligonucleotide
ucaaggaagauggcauuucu

SEQ ID NO: 16379 - RNA, 18 nt, Artificial Sequence
  Description of Artificial Sequence: Synthetic Antisense oligonucleotide
cuguccaagcccgguuga

SEQ ID NO: 16380 - RNA, 20 nt, Artificial Sequence
  Description of Artificial Sequence: Synthetic Antisense oligonucleotide
ucaaggaagauggcauuucu

SEQ ID NO: 16381 - RNA, 18 nt, Artificial Sequence
  Description of Artificial Sequence: Synthetic Antisense oligonucleotide
cuguccaagcccgguuga

SEQ ID NO: 16382 - RNA, 22 nt, Artificial Sequence
  Description of Artificial Sequence: Synthetic Antisense oligonucleotide
ucaaggaagauggcauuucuag

SEQ ID NO: 16383 - RNA, 18 nt, Artificial Sequence
  Description of Artificial Sequence: Synthetic Antisense oligonucleotide
cuguccaagcccgguuga

SEQ ID NO: 16384 - RNA, 22 nt, Artificial Sequence
  Description of Artificial Sequence: Synthetic Antisense oligonucleotide
ucaaggaagauggcauuucuag

SEQ ID NO: 16385 - RNA, 18 nt, Artificial Sequence
  Description of Artificial Sequence: Synthetic Antisense oligonucleotide
cuguccaagcccgguuga

SEQ ID NO: 16386 - RNA, 16 nt, Artificial Sequence
  Description of Artificial Sequence: Synthetic Antisense oligonucleotide
ucaaggaagauggcau

SEQ ID NO: 16387 - RNA, 15 nt, Artificial Sequence
  Description of Artificial Sequence: Synthetic Antisense oligonucleotide
uaaguucuguccaag

SEQ ID NO: 16388 - RNA, 16 nt, Artificial Sequence
  Description of Artificial Sequence: Synthetic Antisense oligonucleotide
ucaaggaagauggcau

SEQ ID NO: 16389 - RNA, 15 nt, Artificial Sequence
  Description of Artificial Sequence: Synthetic Antisense oligonucleotide
uaaguucuguccaag

SEQ ID NO: 16390 - RNA, 15 nt, Artificial Sequence
  Description of Artificial Sequence: Synthetic Antisense oligonucleotide
gaagauggcauuucu

SEQ ID NO: 16391 - RNA, 15 nt, Artificial Sequence
  Description of Artificial Sequence: Synthetic Antisense oligonucleotide
uaaguucuguccaag

SEQ ID NO: 16392 - RNA, 15 nt, Artificial Sequence
  Description of Artificial Sequence: Synthetic Antisense oligonucleotide
gaagauggcauuucu

SEQ ID NO: 16393 - RNA, 15 nt, Artificial Sequence
  Description of Artificial Sequence: Synthetic Antisense oligonucleotide
uaaguucuguccaag

SEQ ID NO: 16394 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16395 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16396 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16397 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16398 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16399 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16400 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16401 - RNA, 18 nt, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
gguaaguucuguccaagc

SEQ ID NO: 16402 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16403 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16404 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16405 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16406 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16407 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16408 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16409 - RNA, 18 nt, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
guaaguucuguccaagcc

SEQ ID NO: 16410 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16411 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16412 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16413 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16414 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16415 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16416 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16417 - RNA, 18 nt, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agucgguaaguucugucc

SEQ ID NO: 16418 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16419 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16420 - RNA, 20 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucu

SEQ ID NO: 16421 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16422 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16423 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16424 - RNA, 22 nt, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
ucaaggaagauggcauuucuag

SEQ ID NO: 16425 - RNA, 18 nt, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
cuguccaagcccgguuga

SEQ ID NO: 16426 - RNA, 16 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcau

SEQ ID NO: 16427 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16428 - RNA, 16 nt, Artificial Sequence
  Description of Artificial Sequence: Synthetic Antisense oligonucleotide
  misc_feature (2)..(2): 5-methyl
  misc_feature (14)..(14): 5-methyl
ucaaggaagauggcau

SEQ ID NO: 16429 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16430 - RNA, 15 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucu

SEQ ID NO: 16431 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16432 - RNA, 15 nt, Artificial Sequence
  Description of Artificial Sequence: Synthetic Antisense oligonucleotide
  misc_feature (9)..(9): 5-methyl
  misc_feature (14)..(14): 5-methyl
gaagauggcauuucu

SEQ ID NO: 16433 - RNA, 15 nt, Artificial Sequence
  Description of Artificial Sequence: Synthetic Antisense oligonucleotide
  misc_feature (7)..(7): 5-methyl
  misc_feature (11)..(12): 5-methyl
uaaguucuguccaag

SEQ ID NO: 16434 - DNA, 20 bp, Artificial Sequence
  Description of Artificial Sequence: Synthetic Antisense oligonucleotide
tcaaggaagatggcatttct

SEQ ID NO: 16435 - DNA, 18 bp, Artificial Sequence
  Description of Artificial Sequence: Synthetic Antisense oligonucleotide
ggtaagttctgtccaagc

SEQ ID NO: 16436 - DNA, 20 bp, Artificial Sequence
  Description of Artificial Sequence: Synthetic Antisense oligonucleotide
tcaaggaagatggcatttct

SEQ ID NO: 16437 - DNA, 18 bp, Artificial Sequence
  Description of Artificial Sequence: Synthetic Antisense oligonucleotide
ggtaagttctgtccaagc

SEQ ID NO: 16438 - DNA, 22 bp, Artificial Sequence
  Description of Artificial Sequence: Synthetic Antisense oligonucleotide
tcaaggaagatggcatttctag

SEQ ID NO: 16439 - DNA, 18 bp, Artificial Sequence
  Description of Artificial Sequence: Synthetic Antisense oligonucleotide
ggtaagttctgtccaagc

SEQ ID NO: 16440 - DNA, 22 bp, Artificial Sequence
  Description of Artificial Sequence: Synthetic Antisense oligonucleotide
tcaaggaagatggcatttctag

SEQ ID NO: 16441 - DNA, 18 bp, Artificial Sequence
  Description of Artificial Sequence: Synthetic Antisense oligonucleotide
ggtaagttctgtccaagc

SEQ ID NO: 16442 - DNA, 20 bp, Artificial Sequence
  Description of Artificial Sequence: Synthetic Antisense oligonucleotide
tcaaggaagatggcatttct

SEQ ID NO: 16443 - DNA, 18 bp, Artificial Sequence
  Description of Artificial Sequence: Synthetic Antisense oligonucleotide
gtaagttctgtccaagcc

SEQ ID NO: 16444 - DNA, 20 bp, Artificial Sequence
  Description of Artificial Sequence: Synthetic Antisense oligonucleotide
tcaaggaagatggcatttct

SEQ ID NO: 16445 - DNA, 18 bp, Artificial Sequence
  Description of Artificial Sequence: Synthetic Antisense oligonucleotide
gtaagttctgtccaagcc

SEQ ID NO: 16446 - DNA, 22 bp, Artificial Sequence
  Description of Artificial Sequence: Synthetic Antisense oligonucleotide
tcaaggaagatggcatttctag

SEQ ID NO: 16447 - DNA, 18 bp, Artificial Sequence
  Description of Artificial Sequence: Synthetic Antisense oligonucleotide
gtaagttctgtccaagcc

SEQ ID NO: 16448 - DNA, 22 bp, Artificial Sequence
  Description of Artificial Sequence: Synthetic Antisense oligonucleotide
tcaaggaagatggcatttctag

SEQ ID NO: 16449 - DNA, 18 bp, Artificial Sequence
  Description of Artificial Sequence: Synthetic Antisense oligonucleotide
gtaagttctgtccaagcc

SEQ ID NO: 16450 - DNA, 20 bp, Artificial Sequence
  Description of Artificial Sequence: Synthetic Antisense oligonucleotide
tcaaggaagatggcatttct

SEQ ID NO: 16451 - DNA, 18 bp, Artificial Sequence
  Description of Artificial Sequence: Synthetic Antisense oligonucleotide
agtcggtaagttctgtcc

SEQ ID NO: 16452 - DNA, 20 bp, Artificial Sequence
  Description of Artificial Sequence: Synthetic Antisense oligonucleotide
tcaaggaagatggcatttct

SEQ ID NO: 16453 - DNA, 18 bp, Artificial Sequence
  Description of Artificial Sequence: Synthetic Antisense oligonucleotide
agtcggtaagttctgtcc

SEQ ID NO: 16454 - DNA, 22 bp, Artificial Sequence
  Description of Artificial Sequence: Synthetic Antisense oligonucleotide
tcaaggaagatggcatttctag

SEQ ID NO: 16455 - DNA, 18 bp, Artificial Sequence
  Description of Artificial Sequence: Synthetic Antisense oligonucleotide
agtcggtaagttctgtcc

SEQ ID NO: 16456 - DNA, 22 bp, Artificial Sequence
  Description of Artificial Sequence: Synthetic Antisense oligonucleotide
tcaaggaagatggcatttctag

SEQ ID NO: 16457 - DNA, 18 bp, Artificial Sequence
  Description of Artificial Sequence: Synthetic Antisense oligonucleotide
agtcggtaagttctgtcc

SEQ ID NO: 16458 - DNA, 20 bp, Artificial Sequence
  Description of Artificial Sequence: Synthetic Antisense oligonucleotide
tcaaggaagatggcatttct

SEQ ID NO: 16459 - DNA, 18 bp, Artificial Sequence
  Description of Artificial Sequence: Synthetic Antisense oligonucleotide
ctgtccaagcccggttga

SEQ ID NO: 16460 - DNA, 20 bp, Artificial Sequence
  Description of Artificial Sequence: Synthetic Antisense oligonucleotide
tcaaggaagatggcatttct

SEQ ID NO: 16461 - DNA, 18 bp, Artificial Sequence
  Description of Artificial Sequence: Synthetic Antisense oligonucleotide
ctgtccaagcccggttga

SEQ ID NO: 16462 - DNA, 22 bp, Artificial Sequence
  Description of Artificial Sequence: Synthetic Antisense oligonucleotide
tcaaggaagatggcatttctag

SEQ ID NO: 16463 - DNA, 18 bp, Artificial Sequence
  Description of Artificial Sequence: Synthetic Antisense oligonucleotide
ctgtccaagcccggttga

SEQ ID NO: 16464 - DNA, 22 bp, Artificial Sequence
  Description of Artificial Sequence: Synthetic Antisense oligonucleotide
tcaaggaagatggcatttctag

SEQ ID NO: 16465 - DNA, 18 bp, Artificial Sequence
  Description of Artificial Sequence: Synthetic Antisense oligonucleotide
ctgtccaagcccggttga

SEQ ID NO: 16466 - DNA, 16 bp, Artificial Sequence
  Description of Artificial Sequence: Synthetic Antisense oligonucleotide
tcaaggaagatggcat

SEQ ID NO: 16467 - DNA, 15 bp, Artificial Sequence
  Description of Artificial Sequence: Synthetic Antisense oligonucleotide
taagttctgtccaag

SEQ ID NO: 16468 - DNA, 16 bp, Artificial Sequence
  Description of Artificial Sequence: Synthetic Antisense oligonucleotide
tcaaggaagatggcat

SEQ ID NO: 16469 - DNA, 15 bp, Artificial Sequence
  Description of Artificial Sequence: Synthetic Antisense oligonucleotide
taagttctgtccaag

SEQ ID NO: 16470 - DNA, 15 bp, Artificial Sequence
  Description of Artificial Sequence: Synthetic Antisense oligonucleotide
gaagatggcatttct

SEQ ID NO: 16471 - DNA, 15 bp, Artificial Sequence
  Description of Artificial Sequence: Synthetic Antisense oligonucleotide
taagttctgtccaag

SEQ ID NO: 16472 - DNA, 15 bp, Artificial Sequence
  Description of Artificial Sequence: Synthetic Antisense oligonucleotide
gaagatggcatttct

SEQ ID NO: 16473 - DNA, 15 bp, Artificial Sequence
  Description of Artificial Sequence: Synthetic Antisense oligonucleotide
taagttctgtccaag

SEQ ID NO: 16474 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16475 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16476 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16477 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16478 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16479 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16480 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16481 - DNA, 18 bp, Artificial Sequence
  Description of Artificial Sequence: Synthetic Antisense oligonucleotide
  misc_feature (9)..(9): 5-methyl
  misc_feature (13)..(14): 5-methyl
  misc_feature (18)..(18): 5-methyl
ggtaagttctgtccaagc

SEQ ID NO: 16482 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16483 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16484 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16485 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16486 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16487 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16488 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16489 - DNA, 18 bp, Artificial Sequence
  Description of Artificial Sequence: Synthetic Antisense oligonucleotide
  misc_feature (8)..(8): 5-methyl
  misc_feature (12)..(13): 5-methyl
  misc_feature (17)..(18): 5-methyl
gtaagttctgtccaagcc

SEQ ID NO: 16490 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16491 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16492 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16493 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16494 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16495 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16496 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16497 - DNA, 18 bp, Artificial Sequence
  Description of Artificial Sequence: Synthetic Antisense oligonucleotide
  misc_feature (4)..(4): 5-methyl
  misc_feature (13)..(13): 5-methyl
  misc_feature (17)..(18): 5-methyl
agtcggtaagttctgtcc

SEQ ID NO: 16498 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16499 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16500 - DNA, 20 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttct

SEQ ID NO: 16501 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16502 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16503 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16504 - DNA, 22 bp, Artificial Sequence
  Description of Artificial Sequence: Synthetic Antisense oligonucleotide
  misc_feature (2)..(2): 5-methyl
  misc_feature (14)..(14): 5-methyl
  misc_feature (19)..(19): 5-methyl
tcaaggaagatggcatttctag

SEQ ID NO: 16505 - DNA, 18 bp, Artificial Sequence
  Description of Artificial Sequence: Synthetic Antisense oligonucleotide
  misc_feature (1)..(1): 5-methyl
  misc_feature (5)..(6): 5-methyl
  misc_feature (10)..(12): 5-methyl
ctgtccaagcccggttga

SEQ ID NO: 16506 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcat

SEQ ID NO: 16507 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16508 - DNA, 16 bp, Artificial Sequence
  Description of Artificial Sequence: Synthetic Antisense oligonucleotide
  misc_feature (2)..(2): 5-methyl
  misc_feature (14)..(14): 5-methyl
tcaaggaagatggcat

SEQ ID NO: 16509 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16510 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttct

SEQ ID NO: 16511 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16512 - DNA, 15 bp, Artificial Sequence
  Description of Artificial Sequence: Synthetic Antisense oligonucleotide
  misc_feature (9)..(9): 5-methyl
  misc_feature (14)..(14): 5-methyl
gaagatggcatttct

SEQ ID NO: 16513 - DNA, 15 bp, Artificial Sequence
  Description of Artificial Sequence: Synthetic Antisense oligonucleotide
  misc_feature (7)..(7): 5-methyl
  misc_feature (11)..(12): 5-methyl
taagttctgtccaag

SEQ ID NO: 16514 - DNA, 20 bp, Artificial Sequence
  Description of Artificial Sequence: Synthetic Antisense oligonucleotide
  Description of Combined DNA/RNA Molecule: Synthetic Antisense oligonucleotide
tcaaggaagauggcauuuct

SEQ ID NO: 16515 - RNA, 18 nt, Artificial Sequence
  Description of Artificial Sequence: Synthetic Antisense oligonucleotide
gguaaguucuguccaagc

SEQ ID NO: 16516 - DNA, 20 bp, Artificial Sequence
  Description of Artificial Sequence: Synthetic Antisense oligonucleotide
  Description of Combined DNA/RNA Molecule: Synthetic Antisense oligonucleotide
tcaaggaagauggcauuuct

SEQ ID NO: 16517 - RNA, 18 nt, Artificial Sequence
  Description of Artificial Sequence: Synthetic Antisense oligonucleotide
gguaaguucuguccaagc

SEQ ID NO: 16518 - DNA, 15 bp, Artificial Sequence
  Description of Artificial Sequence: Synthetic Antisense oligonucleotide
gaagatggcatttct

SEQ ID NO: 16519 - DNA, 15 bp, Artificial Sequence
  Description of Artificial Sequence: Synthetic Antisense oligonucleotide
taagttctgtccaag

SEQ ID NO: 16520 - DNA, 15 bp, Artificial Sequence
  Description of Artificial Sequence: Synthetic Antisense oligonucleotide
gaagatggcatttct

SEQ ID NO: 16521 - DNA, 15 bp, Artificial Sequence
  Description of Artificial Sequence: Synthetic Antisense oligonucleotide
taagttctgtccaag

SEQ ID NO: 16522 - DNA, 16 bp, Artificial Sequence
  Description of Artificial Sequence: Synthetic Antisense oligonucleotide
tcaaggaagatggcat

SEQ ID NO: 16523 - DNA, 15 bp, Artificial Sequence
  Description of Artificial Sequence: Synthetic Antisense oligonucleotide
taagttctgtccaag

SEQ ID NO: 16524 - DNA, 16 bp, Artificial Sequence
  Description of Artificial Sequence: Synthetic Antisense oligonucleotide
tcaaggaagatggcat

SEQ ID NO: 16525 - DNA, 15 bp, Artificial Sequence
  Description of Artificial Sequence: Synthetic Antisense oligonucleotide
taagttctgtccaag

SEQ ID NO: 16526 - DNA, 16 bp, Artificial Sequence
  Description of Artificial Sequence: Synthetic Antisense oligonucleotide
tcaaggaagatggcat

SEQ ID NO: 16527 - DNA, 15 bp, Artificial Sequence
  Description of Artificial Sequence: Synthetic Antisense oligonucleotide
taagttctgtccaag

SEQ ID NO: 16528 - DNA, 16 bp, Artificial Sequence
  Description of Artificial Sequence: Synthetic Antisense oligonucleotide
tcaaggaagatggcat

SEQ ID NO: 16529 - DNA, 15 bp, Artificial Sequence
  Description of Artificial Sequence: Synthetic Antisense oligonucleotide
taagttctgtccaag
